US012674161B2

(12) United States Patent
Abrams et al.

(10) Patent No.: US 12,674,161 B2
(45) Date of Patent: Jul. 7, 2026

(54) STAT3 TARGETING OLIGONUCLEOTIDES AND USES THEREOF

(71) Applicant: NOVO NORDISK A/S, Bagsværd (DK)

(72) Inventors: Marc Abrams, Natick, MA (US); Henryk T. Dudek, Belmont, MA (US); Harini Sivagurunatha Krishnan, Lexington, MA (US); Shanthi Ganesh, Shrewsbury, MA (US)

(73) Assignee: NOVO NORDISK A/S, Bagsværd (DK)

( * ) Notice: Subject to any disclaimer, the term of this patent is extended or adjusted under 35 U.S.C. 154(b) by 0 days.

(21) Appl. No.: 19/210,160

(22) Filed: May 16, 2025

(65) Prior Publication Data

US 2025/0290071 A1 Sep. 18, 2025

Related U.S. Application Data

(63) Continuation of application No. PCT/US2023/080076, filed on Nov. 16, 2023.

(60) Provisional application No. 63/425,861, filed on Nov. 16, 2022.

(51) Int. Cl.

| | |
|---|---|
| ***C12N 15/113*** | (2010.01) |
| ***A61K 45/06*** | (2006.01) |
| ***A61P 35/00*** | (2006.01) |

(52) U.S. Cl.

CPC ............ *C12N 15/113* (2013.01); *A61K 45/06* (2013.01); *A61P 35/00* (2018.01); *C12N 2310/11* (2013.01); *C12N 2310/14* (2013.01); *C12N 2310/3515* (2013.01); *C12N 2320/31* (2013.01)

(58) Field of Classification Search

CPC .............. C12N 15/113; C12N 2310/11; C12N 2310/14; C12N 2310/3515; A61P 35/00; A61K 31/7088

See application file for complete search history.

(56) References Cited

U.S. PATENT DOCUMENTS

| | | | |
|---|---|---|---|
| 4,683,202 | A | 7/1987 | Mullis |
| 5,426,039 | A | 6/1995 | Wallace et al. |
| 5,804,683 | A | 9/1998 | Usman et al. |
| 5,831,071 | A | 11/1998 | Usman et al. |
| 5,998,203 | A | 12/1999 | Matulic-Adamic et al. |
| 6,008,400 | A | 12/1999 | Scaringe et al. |
| 6,111,086 | A | 8/2000 | Scaringe |
| 6,117,657 | A | 9/2000 | Usman et al. |
| 6,353,098 | B1 | 3/2002 | Usman et al. |
| 6,362,323 | B1 | 3/2002 | Usman et al. |
| 6,437,117 | B1 | 8/2002 | Usman et al. |
| 6,469,158 | B1 | 10/2002 | Usman et al. |
| 7,491,805 | B2 | 2/2009 | Vargeese et al. |
| 7,645,747 | B2 | 1/2010 | Boojamra et al. |
| 7,696,345 | B2 | 4/2010 | Allerson et al. |
| 7,750,144 | B2 | 7/2010 | Zamore et al. |
| 7,786,290 | B2 | 8/2010 | Woppmann et al. |
| 7,923,547 | B2 | 4/2011 | McSwiggen et al. |
| 7,943,743 | B2 | 5/2011 | Korman et al. |
| 8,008,449 | B2 | 8/2011 | Korman et al. |
| 8,084,599 | B2 | 12/2011 | Rossi et al. |
| 8,168,757 | B2 | 5/2012 | Finnefrock et al. |
| 8,273,866 | B2 | 9/2012 | McSwiggen et al. |
| 8,334,373 | B2 | 12/2012 | Vornlocher et al. |
| 8,354,509 | B2 | 1/2013 | Carven et al. |
| 8,372,968 | B2 | 2/2013 | Tuschl et al. |
| 8,513,207 | B2 | 8/2013 | Brown |
| 8,747,847 | B2 | 6/2014 | Rotem-Yehudar et al. |
| 8,877,917 | B2 | 11/2014 | Forst et al. |
| 8,883,996 | B2 | 11/2014 | Rossi et al. |
| 8,927,513 | B2 | 1/2015 | Manoharan et al. |
| 8,927,705 | B2 | 1/2015 | Brown |
| 8,987,435 | B2 | 3/2015 | Swayze et al. |
| 9,012,138 | B2 | 4/2015 | Tuschl et al. |
| 9,012,621 | B2 | 4/2015 | Tuschl et al. |
| 9,074,213 | B2 | 7/2015 | Kreutzer et al. |
| 9,193,753 | B2 | 11/2015 | Tuschl et al. |
| 9,222,091 | B2 | 12/2015 | Manoharan et al. |
| 9,260,471 | B2 | 2/2016 | Cancilla et al. |
| 9,320,798 | B2 | 4/2016 | Brown |
| 9,422,339 | B2 | 8/2016 | Sasikumar et al. |
| 9,549,983 | B2 | 1/2017 | Brown et al. |
| 9,567,587 | B2 | 2/2017 | Freier et al. |
| 9,790,498 | B2 | 10/2017 | Brown et al. |
| 9,850,283 | B2 | 12/2017 | Miller et al. |
| 9,920,123 | B2 | 3/2018 | Irving et al. |

(Continued)

FOREIGN PATENT DOCUMENTS

| | | | |
|---|---|---|---|
| CA | 2677068 | A1 | 3/2011 |
| EP | 2280070 | A1 | 2/2011 |

(Continued)

OTHER PUBLICATIONS

Chapuis et al., 2008, Tetrahedron Letters, (2008), p. 6838-6840 (Year: 2008).*

(Continued)

*Primary Examiner* — Soren Harward

*Assistant Examiner* — Jenna L Persons

(74) *Attorney, Agent, or Firm* — Foley Hoag LLP; Ariana D. Harris; Samantha N. Devenport

(57) ABSTRACT

The subject matter disclosed herein is directed to modulating STAT3 gene expression using siRNA compositions and methods directed to affecting key cell populations supporting the growth and metastasis of cancer to affect the beneficial treatment, remission or removal of the underlying tumor in a patient.

12 Claims, 35 Drawing Sheets

Specification includes a Sequence Listing.

(56) References Cited

U.S. PATENT DOCUMENTS

| | | | |
|---|---|---|---|
| 9,987,500 | B2 | 6/2018 | Papadopoulos et al. |
| 10,144,725 | B2 | 12/2018 | Brown |
| 10,487,330 | B2 | 11/2019 | Brown et al. |
| 10,590,105 | B2 | 3/2020 | Yeung et al. |
| 10,676,742 | B2 | 6/2020 | Brown et al. |
| 10,745,480 | B2 | 8/2020 | Pedersen et al. |
| 10,745,704 | B2 | 8/2020 | DeFougerolles et al. |
| 10,889,813 | B2 | 1/2021 | Hinkle |
| 10,982,215 | B2 | 4/2021 | Hinkle |
| 11,130,740 | B2 | 9/2021 | Bi et al. |
| 11,390,642 | B2 | 7/2022 | Wang et al. |
| 11,414,659 | B2 | 8/2022 | Wang et al. |
| 11,555,029 | B2 | 1/2023 | Aktoudianakis et al. |
| 11,873,488 | B2 | 1/2024 | Wang et al. |
| 2005/0196781 | A1 | 9/2005 | Robin et al. |
| 2006/0217339 | A1 | 9/2006 | Karras |
| 2006/0276422 | A1 | 12/2006 | Usman et al. |
| 2007/0254362 | A1 | 11/2007 | Quay et al. |
| 2008/0274462 | A1 | 11/2008 | Jeon et al. |
| 2008/0317839 | A1 | 12/2008 | Quay et al. |
| 2009/0023675 | A1 | 1/2009 | McSwiggen et al. |
| 2009/0099115 | A1 | 4/2009 | McSwiggen et al. |
| 2009/0176725 | A1 | 7/2009 | Morrissey et al. |
| 2009/0220587 | A1 | 9/2009 | Allon et al. |
| 2009/0285881 | A1 | 11/2009 | Dande et al. |
| 2010/0055168 | A1 | 3/2010 | Dande et al. |
| 2010/0063135 | A1 | 3/2010 | Dande et al. |
| 2010/0173973 | A1 | 7/2010 | Brown |
| 2010/0173974 | A1 | 7/2010 | Brown |
| 2010/0197023 | A1 | 8/2010 | Leake et al. |
| 2010/0204305 | A1 | 8/2010 | Young et al. |
| 2011/0110972 | A1 | 5/2011 | Vasievich et al. |
| 2011/0111056 | A1 | 5/2011 | Basu et al. |
| 2011/0118340 | A1 | 5/2011 | Manoharan et al. |
| 2011/0223188 | A1 | 9/2011 | Langermann |
| 2011/0288147 | A1 | 11/2011 | Brown |
| 2011/0294869 | A1 | 12/2011 | Petersen |
| 2012/0065125 | A1 | 3/2012 | Yu et al. |
| 2012/0095200 | A1 | 4/2012 | Brown |
| 2012/0121515 | A1 | 5/2012 | Dang et al. |
| 2012/0202874 | A1 | 8/2012 | Karras |
| 2013/0011922 | A1 | 1/2013 | Quay et al. |
| 2013/0017199 | A1 | 1/2013 | Langermann |
| 2013/0338210 | A1 | 12/2013 | Manoharan et al. |
| 2015/0203847 | A1 | 7/2015 | Manoharan et al. |
| 2015/0265708 | A1 | 9/2015 | Manoharan et al. |
| 2016/0319363 | A1 | 11/2016 | Bentwich et al. |
| 2017/0306332 | A1* | 10/2017 | Brown ........... C12Y 101/01027 |
| 2018/0305315 | A1 | 10/2018 | Aktoudianakis et al. |
| 2019/0002880 | A1 | 1/2019 | Woolf et al. |
| 2019/0151461 | A1 | 5/2019 | Brown et al. |
| 2019/0194654 | A1 | 6/2019 | Woessner et al. |
| 2020/0031862 | A1 | 1/2020 | Brown et al. |
| 2020/0270605 | A1 | 8/2020 | Khvorova et al. |
| 2021/0269797 | A1 | 9/2021 | Beigelman et al. |
| 2021/0277403 | A1 | 9/2021 | Beigelman et al. |
| 2021/0388358 | A1 | 12/2021 | Brown |
| 2022/0170025 | A1 | 6/2022 | Brown et al. |
| 2022/0177880 | A1 | 6/2022 | Brown et al. |
| 2022/0220485 | A1 | 7/2022 | Jaschinski et al. |
| 2022/0389430 | A1 | 12/2022 | Wang et al. |
| 2023/0069235 | A1 | 3/2023 | Brown et al. |
| 2023/0123981 | A1 | 4/2023 | Wang et al. |
| 2023/0277675 | A1 | 9/2023 | Wang et al. |
| 2024/0124875 | A1 | 4/2024 | Ganesh et al. |
| 2024/0287512 | A1 | 8/2024 | Grim et al. |
| 2025/0163097 | A1 | 5/2025 | Komisarski et al. |

FOREIGN PATENT DOCUMENTS

| | | | | |
|---|---|---|---|---|
| EP | 2513334 | A1 | 10/2012 | |
| EP | 2774989 | A1 | 9/2014 | |
| EP | 3503730 | A1 | 7/2019 | |
| EP | 4021915 | A1 | 7/2022 | |
| EP | 4225919 | A1 | 8/2023 | |
| EP | 4284933 | A1 | 12/2023 | |
| EP | 4392556 | A1 | 7/2024 | |
| EP | 4426839 | A1 | 9/2024 | |
| EP | 4430190 | A2 | 9/2024 | |
| EP | 4493568 | A1 | 1/2025 | |
| WO | WO-2005/001092 | A2 | 1/2005 | |
| WO | WO-2006/133396 | A2 | 12/2006 | |
| WO | WO-2007/084865 | A2 | 7/2007 | |
| WO | WO-2007/150071 | A1 | 12/2007 | |
| WO | WO-2008/153743 | A2 | 12/2008 | |
| WO | WO-2009/129385 | A1 | 10/2009 | |
| WO | WO-2010/030730 | A1 | 3/2010 | |
| WO | WO-2010/033225 | A2 | 3/2010 | |
| WO | WO-2010/048228 | A2 | 4/2010 | |
| WO | WO-2010/054405 | A1 | 5/2010 | |
| WO | WO-2010/141726 | A2 | 12/2010 | |
| WO | WO-2011/005860 | A2 | 1/2011 | |
| WO | WO-2011/022460 | A1 | 2/2011 | |
| WO | WO-2011/056883 | A1 | 5/2011 | |
| WO | WO-2011/072292 | A2 | 6/2011 | |
| WO | WO-2011/075188 | A1 | 6/2011 | |
| WO | WO-2011/075656 | A1 | 6/2011 | |
| WO | WO-2011/123621 | A2 | 10/2011 | |
| WO | WO-2011/133871 | A2 | 10/2011 | |
| WO | WO-2012/000104 | A1 | 1/2012 | |
| WO | WO-2012/030683 | A2 | 3/2012 | |
| WO | WO-2013/032643 | A2 | 3/2013 | |
| WO | WO-2013/033230 | A1 | 3/2013 | |
| WO | WO-2013074974 | A2 | 5/2013 | |
| WO | WO-2013/165816 | A2 | 11/2013 | |
| WO | WO-2014/088920 | A1 | 6/2014 | |
| WO | WO-2015/004636 | A1 | 1/2015 | |
| WO | WO-2015/069932 | A1 | 5/2015 | |
| WO | WO-2015/085158 | A1 | 6/2015 | |
| WO | WO-2015/106128 | A2 | 7/2015 | |
| WO | WO-2015/188197 | A2 | 12/2015 | |
| WO | WO-2016/028649 | A1 | 2/2016 | |
| WO | WO-2016/100401 | A1 | 6/2016 | |
| WO | WO-2016/149020 | A1 | 9/2016 | |
| WO | WO-2016/149313 | A1 | 9/2016 | |
| WO | WO-2016/168286 | A1 | 10/2016 | |
| WO | WO-2017/011831 | A1 | 1/2017 | |
| WO | WO-2017/100587 | A1 | 6/2017 | |
| WO | WO-2017/157899 | A1 | 9/2017 | |
| WO | WO-2018/039364 | A1 | 3/2018 | |
| WO | WO-2018045317 | A1 * | 3/2018 | .............. A61P 43/00 |
| WO | WO-2018/185241 | A1 | 10/2018 | |
| WO | WO-2018/216014 | A1 | 11/2018 | |
| WO | WO-2019/000149 | A1 | 1/2019 | |
| WO | WO-2019/076343 | A1 | 4/2019 | |
| WO | WO-2019/200124 | A1 | 10/2019 | |
| WO | WO-2019/217459 | A1 | 11/2019 | |
| WO | WO-2019/232255 | A1 | 12/2019 | |
| WO | WO-2020/123083 | A1 | 6/2020 | |
| WO | WO-2020/132227 | A2 | 6/2020 | |
| WO | WO-2020/206350 | A1 | 10/2020 | |
| WO | WO-2020/226960 | A1 | 11/2020 | |
| WO | WO-2020/257194 | A1 | 12/2020 | |
| WO | WO-2021/067744 | A1 | 4/2021 | |
| WO | WO-2021/146488 | A1 | 7/2021 | |
| WO | WO-2021/173811 | A1 | 9/2021 | |
| WO | WO-2021/173812 | A1 | 9/2021 | |
| WO | WO-2021/231741 | A2 | 11/2021 | |
| WO | WO-2022031433 | A1 * | 2/2022 | ........... A61K 47/543 |
| WO | WO-2022/187622 | A1 | 9/2022 | |
| WO | WO-2022/219065 | A1 | 10/2022 | |
| WO | WO-2023/060141 | A2 | 4/2023 | |
| WO | WO-2023/081822 | A1 | 5/2023 | |
| WO | WO-2023081500 | A2 * | 5/2023 | ........... A61K 31/713 |
| WO | WO-2023/178141 | A2 | 9/2023 | |
| WO | WO-2024040041 | A1 * | 2/2024 | ........... A61K 31/713 |
| WO | WO-2024/107993 | | 5/2024 | |
| WO | WO-2025/029625 | | 2/2025 | |

OTHER PUBLICATIONS

Gatta et al., 2018, Expert Opinion on Drug Discovery, vol. 13, No. 8, p. 709-725 (Year: 2018).*

(56) References Cited

OTHER PUBLICATIONS

Construct: shRNA TRCN0000071456, Gpp Web Portal, Broad Institute, https://portals.broadinstitute.org/gpp/public/clone/details?cloneId=TRCN0000071456 (Year: 2015).*
Kubo et al., Dec. 21, 2020, ACS Chemical Biology, 16, p. 150-164 (Year: 2020).*
Schutz et al., Apr. 26, 2015, Transl. Oncol., 2, p. 97-105 (Year: 2015).*
*Homo sapiens* signal transducer and activator of transcription 3 (STAT3), transcript variant 4, mRNA, NCBI Reference Sequence: NM_001369512.1, available Oct. 31, 2021 (Year: 2021).*
Allerson et al., "Fully 2'-Modified Oligonucleotide Duplexes with Improved in Vitro Potency and Stability Compared to Unmodified Small Interfering RNA", Journal of Medicinal Chemistry, vol. 48, No. 4, Jan. 20, 2005, pp. 901-904.
Biscans et al., "The valency of fatty acid conjugates impacts siRNA pharmacokinetics, distribution, and efficacy in vivo". Journal of controlled release. 302, 116-125, (2019).
Bottaro et al., "Mapping the Universe of RNA Tetraloop Folds", Biophysical Journal, 2017, vol. 113, pp. 257-267.
Dicerna Pharmaceuticals, Inc., "Taking RNAi under the skin," Nature.com. 2016:B12; Retrieved from the Internet: https://media.nature.com/original/magazine-assets/d43747-020-00189-y/d43747-020-00189-y.pdf.
Foster et al., "Advanced siRNA Designs Further Improve In Vivo Performance of GaINAc-SIRNA Conjugates", Molecular Therapy, vol. 26, No. 3, Mar. 2018, pp. 708-717.
Gajewski et al., "Cancer immunotherapy strategies based on overcoming barriers within the tumor microenvironment", Current Opinion in Immunology, Apr. 1, 2013, vol. 25, No. 2, pp. 268-276.
Gajewski et al., "Innate and adaptive immune cells in the tumor microenvironment", Nat Immunol., Oct. 2013, vol. 14, No. 10, pp. 1014-1022.
Hall, "Mighty tiny", RNA, Apr. 1, 2015, vol. 21, pp. 630-631.
Huang et al., "VEGF suppresses T-lymphocyte infiltration in the tumor microenvironment through inhibition of NF-κB-induced endothelial activation", The FASEB Journal, Jan. 2015, vol. 29, No. 1, pp. 227-238.
Kawakami et al., "Improvement of cancer immunotherapy by combining molecular targeted therapy", Frontiers in Oncology, May 2013, vol. 3, Article 136, 7 pages.
Kenski et al., "siRNA-optimized Modifications for Enhanced In Vivo Activity", Molecular Therapy—Nucleic Acids, vol. 1, e5, Jan. 24, 2012, pp. 1-8.
Koizumi, "Nucleic acids therapeutics using chemical modified oligonucleotides," Medchem News, vol. 25, No. 2, May 1, 2015, pp. 103-108.
Kubo et al., "Lipid-Conjugated 27-Nucleotide Double-Stranded RNAs with Dicer-Substrate Potency Enhance RNAi-Mediated Gene Silencing", Molecular Pharmaceuticals, May 7, 2012, vol. 9, No. 5, pp. 1374-1382.
Leonard et al., "Effects of osmolytes and macromolecular crowders on stable GAAA tetraloops and their preference for a CG closing base pair", PeerJ, 2018, 6:e4236; DOI 10.7717/peerj.4236, 16 pages.
Mikula et al., DMDO preparation and glycal epoxidation, J. Org, Process Res. Dev. 2013, 17, 313-316.
Minikel, "Antisense part III: chemistries," CureFFI.org, Comparison of Chemical Modifications, Aug. 28, 2018, 16 Pages.
Nair et al., "Impact of Enhanced Metabolic Stability on Pharmacokinetics and Pharmacodynamics of GalNAc-siRNA Conjugates", Nucleic Acids Research, vol. 45, No. 19, Published online Sep. 15, 2017, pp. 10969-10977, pp. 1-11.
Ott et al., "CTLA-4 and PD-1/PD-L1 Blockade: New Immunotherapeutic Modalities with Durable Clinical Benefit in Melanoma Patients", Clinical Cancer Research, Oct. 1, 2013, vol. 19, No. 19, pp. 5300-5309.
Podbevsek et al., "Solution-state structure of a fully alternately 2'-F/2'-OMe modified 42-nt dimeric siRNA construct," Nucleic Acids Res. Nov. 2010;38(20):7298-307.
Proia et al., "STAT3 Antisense Oligonucleotide Remodels the Suppressive Tumor Microenvironment to Enhance Immune Activation in Combination with Anti-PD-L1", Clinical Cancer Research, Dec. 1, 2020 Published Online First Sep. 17, 2020, vol. 26, No. 23, pp. 6335-6351, 17 Pages.
Spranger et al., "Mechanism of tumor rejection with doublets of CTLA-4, PD-1/PD-L1, or IDO blockade involves restored IL-2 production and proliferation of CD8+ T cells directly within the tumor microenvironment", Journal for Immuno Therapy of Cancer, Feb. 2014, vol. 2, No. 3, 14 pages.
Spranger et al., "Tumor-intrinsic oncogene pathways mediating immune avoidance", Oncoimmunology 2016, vol. 5, No. 3, e1086862, 7 pages.
Yue et al., "INCB24360 (Epacadostat), a highly potent and selective indoleamine-2, 3-dioxygenase 1 (ID01) inhibitor for immuno-oncology", ACS medicinal chemistry letters, 2017, vol. 8, No. 4, pp. 486-491.
Zakharia et al., Phase II trial of theIndoleamine 2, 3-dioxygenase pathway (IDO) inhibitor indoximod plus immune checkpoint inhibitors for the treatment of unresectable stage 3 or 4 melanoma. European Cancer Congress, Jul. 2016, 76 (14_Supplement): Abstract CT087 (Year: 2016).
Zhou et al., "Current RNA-based Therapeutics in Clinical Trials," Current Gene Therapy, 2019;19(3):172-196.
Abbas et al., 'An Overview of Cancer Treatment Modalities', Neoplasm. InTech, Sep. 19, 2018. doi: 10.5772/intechopen.76558.
Abe et al., "Dumbbell-Shaped Nanocircular RNAs for RNA Interference", J Am Chem Soc. Dec. 12, 2007; vol. 129, No. 49, pp. 15108-15109.
Akinleye et al., "Immune checkpoint inhibitors of PD-L1 as cancer therapeutics," J Hematol Oncol. Sep. 5, 2019;12(1):92.
Antao et al., "A thermodynamic study of unusually stable RNA and DNA hairpins", Nucleic Acids Res., Nov. 1991, vol. 19, No. 21, pp. 5901-5905.
Arnheim et al., "Polymerase Chain Reaction," Chem. Eng. News 1990, 68, 40, 36-47.
Barati et al., "A review of PD-1/PD-L1 siRNA delivery systems in immune T cells and cancer cells," Int Immunopharmacol. Oct. 2022:111:109022.
Barringer et al., "Blunt-end and single-strand ligations by *Escherichia coli* ligase: influence on an in vitro amplification scheme," Gene. Apr. 30, 1990;89(1):117-22.
Bastaki et al., "Codelivery of STAT3 and PD-L1 siRNA by hyaluronate-TAT trimethyl/thiolated chitosan nanoparticles suppresses cancer progression in tumor-bearing mice." Life Science 266 (2021): 118847.
Beaucage et al., "Deoxynucleoside Phosphoramidites—A New Class of Key Intermediates for Deoxypolynucleotide Synthesis", Tetrahedron Lett., 1981, vol. 22, pp. 1859-1862.
Bennett et al., "Pharmacology of Antisense Drugs", Annu Rev Pharmacol Toxicol., Jan. 2017, vol. 57, pp. 81-105.
Bramsen et al., "Improved silencing properties using small internally segmented interfering RNAs", Nucleic Acids Res., 2007, vol. 35, No. 17, pp. 5886-5897.
Breton et al., "siRNA knockdown of PD-L1 and PD-L2 in monocyte-derived dendritic cells only modestly improves proliferative responses to Gag by CD8(+) T cells from HIV-1-infected individuals," J Clin Immunol. Sep. 2009;29(5):637-45.
Bu et al., "STAT3 Induces Immunosuppression by Upregulating PD-1/PD-L1 in HNSCC," J Dent Res. Aug. 2017;96(9):1027-1034.
Chang et al., "Asymmetric shorter-duplex siRNA structures trigger efficient gene silencing with reduced nonspecific effects", Mol Ther., Apr. 2009, vol. 17, No. 4, pp. 725-732.
Cheng et al., "A critical role for Stat3 signaling in immune tolerance," Immunity. Sep. 2003;19(3):425-36.
Cheng et al., "Long PCR," Nature. Jun. 23, 1994;369(6482):684-5.
Cheong et al., "Solution structure of an unusually stable RNA hairpin, 5GGAC(UUCG)GUCC", Nature, Aug. 1990, vol. 346, pp. 680-682.
Chernikov et al., "Current Development of siRNA Bioconjugates: From Research to the Clinic", Front Pharmacology, Apr. 2019, vol. 10, No. 444, pp. 1-25.

(56) References Cited

OTHER PUBLICATIONS

Cornish-Bowden, "Nomenclature for incompletely specified bases in nucleic acid sequences: recommendations 1984", Nucleic Acids Res., May 1985, vol. 13, No. 9, pp. 3021-3030.
Damha et al., "Oligoribonucleotide synthesis. The silyl-phosphoramidite method", Methods Mol. Biol., 1993, vol. 20, pp. 81-114.
Dellinger et al., "Solid-phase chemical synthesis of phosphonoacetate and thiophosphonoacetate oligodeoxynucleotides," J Am Chem Soc. Jan. 29, 2003;125(4):940-50.
Edwards et al,, "The Remarkable Flexibility of the Human Antibody Repertoire; Isolation of Over One Thousand Different Antibodies to a Single Protein, BLyS", JMB, Dec. 2003, vol. 334, pp. 103-118.
Elsner, "Single-stranded siRNAs for in vivo gene silencing", Nat Biotechnol., Nov. 2012, vol. 30, No. 11, p. 1063.
Guatelli et al., "Isothermal, in vitro amplification of nucleic acids by a multienzyme reaction modeled after retroviral replication," Proc. Natl. Acad. Sci. USA. Year 1990, vol. 87, pp. 1874-1878.
Guha et al. "STAT3 inhibition induces Bax-dependent apoptosis in liver tumor myeloid-derived suppressor cells." Oncogene 38(4) (2019): 533-548.
Hamilton et al., "Two classes of short interfering RNA in RNA silencing", EMBO J., Sep. 2, 2002, vol. 21, No. 17, pp. 4671-4679.
Heus et al., "Structural Features That Give Rise to the Unusual Stability if RNA Hairpins Containing GNRA Loops", Science, 1991, vol. 253, pp. 191-194.
Hohjoh, "Enhancement of RNAi activity by improved siRNA duplexes", FEBS Lett., Jan. 2004, vol. 557, No. 1-3, pp. 193-198.
Hu et al., "Therapeutic siRNA: state of the art," Signal Transduct Target Ther. Jun. 19, 2020;5(1):101.
Hughes et al., "Synthetic DNA Synthesis and Assembly: Putting the Synthetic in Synthetic Biology", Cold Spring Harb Perspect Biol., Jan. 2017, vol. 9, No. 1, Article No. a023812, pp. 1-17.
Huynh et al., "Therapeutically exploiting STAT3 activity in cancer—using tissue repair as a road map," Nat Rev Cancer. Feb. 2019;19(2):82-96.
Imanishi et al., "BNAs: novel nucleic acid analogs with a bridged sugar moiety", Chem Commun. (Camb), Aug. 2002, vol. 21, pp. 1653-1659.
International Preliminary Report on Patentability for International Application No. PCT/US22/18911 dated Aug. 29, 2023.
International Preliminary Report on Patentability for International Application No. PCT/US23/64381 dated Sep. 26, 2024.
International Preliminary Report on Patentability for International Application No. PCT/US23/80076 dated May 30, 2025.
International Search Report and Written Opinion for International Application No. PCT/US22/18911 dated Aug. 15, 2022.
International Search Report and Written Opinion for International Application No. PCT/US23/64381 dated Aug. 24, 2023.
International Search Report and Written Opinion for International Application No. PCT/US23/80076 dated May 15, 2024.
International Search Report and Written Opinion for International Application No. PCT/US24/39733 dated Jan. 10, 2025.
Invitation to Pay Additional Fees for International Application No. PCT/US23/80076 dated Mar. 20, 2024.
Johnsson et al., "Comparison of methods for immobilization to carboxymethyl dextran sensor surfaces by analysis of the specific activity of monoclonal antibodies," J Mol Recognit. Jan.-Apr. 1995;8(1-2):125-31.
Johnsson et al., "Immobilization of proteins to a carboxymethyldextran-modified gold surface for biospecific interaction analysis in surface plasmon resonance sensors," Anal Biochem. Nov. 1, 1991;198(2):268-77.
Jönsson et al., "Introducing a biosensor based technology for real-time biospecific interaction analysis," Ann Biol Clin (Paris). 1993;51(1):19-26.
Jonsson et al., "Real-time biospecific interaction analysis using surface plasmon resonance and a sensor chip technology," Biotechniques. Nov. 1991;11(5):620-7.
Klemm et al., "Microenvironmental regulation of therapeutic response in cancer," Trends Cell Biol. Apr. 2015;25(4):198-213.
Kortylewski et al., "Myeloid cells as a target for oligonucleotide therapeutics: turning obstacles into opportunities," Cancer Immunol Immunother. Aug. 2017;66(8):979-988.
Koshkin et al., "LNA (Locked Nucleic Acids): Synthesis of the adenine, cytosine, guanine, 5-methylcytosine, thymine and uracil bicyclonucleoside monomers, oligomerisation, and unprecedented nucleic acid recognition", Tetrahedon, Apr. 1998, vol. 54, pp. 3607-3630.
Kraynack et al., "Small interfering RNAs containing full 2'-O-methylribonucleotide-modified sense strands display Argonaute2/eIF2C2-dependent activity", RNA, 2006, vol. 12, pp. 163-176.
Kwoh et al., Transcription-based amplification system and detection of amplified human immunodeficiency virus type 1 with a bead-based sandwich hybridization format, "Proc. Natl. Acad. Sci. USA", Year 1989, vol. 86, pp. 1173-1177.
Landegren et al., "A ligase-mediated gene detection technique," Science. Aug. 26, 1988;241(4869):1077-80.
Lau et al., "Targeting STAT3 in Cancer with Nucleotide Therapeutics," Cancers (Basel). Oct. 29, 2019;11(11):1681.
Li et al., "Exosomes-delivered PD-L1 siRNA and CTLA-4 siRNA protect against growth and tumor immune escape in colorectal cancer." Genomics 115.4 (2023): 110646.
Lin et al., "Progress in PD-1/PD-L1 pathway inhibitors: From biomacromolecules to small molecules," Eur J Med Chem. Jan. 15, 2020:186:111876.
Loakes et al., "3-Nitropyrrole and 5-nitroindole as universal bases in primers for DNA sequencing and PCR", Nucleic Acids Res., Jul. 1995, vol. 23, pp. 2361-2366.
Loakes et al., "5-Nitroindole as an universal base analogue", Nucleic Acids Res., Oct. 1994, vol. 22, pp. 4039-4043.
Lomeli et al., "Quantitative assays based on the use of replicatable hybridization probes," Clin Chem. Sep. 1989;35(9):1826-31.
Matsui et al., "Argonaute 2-dependent Regulation of Gene Expression by Single-stranded miRNA Mimics", Mol Ther., May 2016, vol. 24, No. 5, pp. 946-955.
McCafferty et al., "Phage antibodies: filamentous phage displaying antibody variable domains," Nature. Dec. 6, 1990;348(6301):552-4.
Meade et al., "Efficient delivery of RNAi prodrugs containing reversible charge-neutralizing phosphotriester backbone modifications", Nature Biotechnology, Dec. 2014, vol. 32, No. 12, pp. 1256-1261.
Moore et al., "Short hairpin RNA (shRNA): design, delivery, and assessment of gene knockdown", Methods Mol Biol., 2010, vol. 629, pp. 141-158.
Nakano et al., "Selection for thermodynamically stable DNA tetraloops using temperature gradient gel electrophoresis reveals four motifs: d(cGNNAg), d(cGNABg),d(cCNNGg), and d(gCNNGc)", Biochemistry, Dec. 2002, vol. 41, pp. 14281-92.
Pershad et al., "Generating a panel of highly specific antibodies to 20 human SH2 domains by phage display," Protein Eng Des Sel. Apr. 2010;23(4):279-88.
Prakash et al., "Identification of metabolically stable 5'-phosphate analogs that support single-stranded siRNA activity", Nucleic Acids Res., Mar. 2015, vol. 43, pp. 2993-3011.
Sasikumar et al., "Small Molecule Agents Targeting PD-1 Checkpoint Pathway for Cancer Immunotherapy: Mechanisms of Action and Other Considerations for Their Advanced Development," Front Immunol. May 2, 2022:13:752065.
Scaringe et al., "Chemical synthesis of biologically active oligoribonucleotides using beta-cyanoethyl protected ribonucleoside phosphoramidites", Nucleic Acids Res., Sep. 1990, vol. 18, pp. 5433-5441.
Schofield et al., "Application of phage display to high throughput antibody generation and characterization," Genome Biol. 2007;8(11):R254.
Shinji et al., Nippon Kagakkai Koen Yokoshu, 2000, vol. 78, p. 731.
Snead et al., "5' Unlocked Nucleic Acid Modification Improves siRNA Targeting", Mol. Ther-Nucl. Acids, Jul. 2013, vol. 2, No. 7, e103, pp. 1-7.
Sooknanan et al., "NASBA," Bio/Technology. 1995; 13:563-4.

(56) References Cited

OTHER PUBLICATIONS

Su et al., "STAT3 in Tumor-Associated Myeloid Cells: Multitasking to Disrupt Immunity," Int J Mol Sci. Jun. 19, 2018;19(6):1803.
Sun et al., "Asymmetric RNA duplexes mediate RNA interference in mammalian cells", Nat Biotechnol. Dec. 2008, vol. 26, No. 12, pp. 1379-1382.
Usman et al., "The automated chemical synthesis of long oligoribuncleotides using 2'-O-silylated ribonucleoside 3'-O-phosphoramidites on a controlled-pore glass support: synthesis of a 43-nucleotide sequence similar to the 3'-half molecule of an *Escherichia coli* formylmethionine tRNA", J. Am. Chem. Soc., Dec. 1987, vol. 109, pp. 7845-7854.
Van Aerschot et al., "An acyclic 5-nitroindazole nucleoside analogue as ambiguous nucleoside", Nucleic Acids Res., Dec. 1995, vol. 23, No. 21, pp. 4363-4370.
Van Brunt, "Amplifying genes: PCR and its alternatives," Biotechnology (N Y). Apr. 1990;8(4):291-4.
Vasquez-Dunndel et al., "STAT3 regulates arginase-I in myeloid-derived suppressor cells from cancer patients," J Clin Invest. Apr. 2013;123(4):1580-9.
Wang et al., "A Small Molecule Antagonist of PD-1/PD-L1 Interactions Acts as an Immune Checkpoint Inhibitor for NSCLC and Melanoma Immunotherapy," Front Immunol. May 14, 2021:12:654463.
Wang et al., "Attenuation of STAT3 Phosphorylation Promotes Apoptosis and Chemosensitivity in Human Osteosarcoma Induced by Raddeanin A," Int J Biol Sci. Jan. 24, 2019;15(3):668-679.
Wincott et al., "Synthesis, deprotection, analysis and purification of RNA and ribosomes", Nucleic Acids Res., Jul. 1995, vol. 23, No. 14, pp. 2677-2684.
Woese et al., "Architecture of ribosomal RNA: constraints on the sequence of "tetra-loops"", PNAS, Nov. 1990, vol. 87, pp. 8467-8471.
Wong et al., "Do STAT3 inhibitors have potential in the future for cancer therapy?" Expert Opin Investig Drugs. Aug. 2017;26(8):883-887.
Wu and Wallace, "The ligation amplification reaction (LAR)—Amplification of specific DNA sequences using sequential rounds of template-dependent ligation," Genomics., May 1989, vol. 4, Issue 4, pp. 560-569.
Wu et al., "Small molecule inhibitors targeting the PD-1/PD-L1 signaling pathway," Acta Pharmacol Sin. Jan. 2021;42(1):1-9.
Yamaoka et al., "Molecular-Targeted Therapies for Epidermal Growth Factor Receptor and Its Resistance Mechanisms," Int J Mol Sci. Nov. 15, 2017;18(11):2420.
Yin et al., "Rational Design of Potent Peptide Inhibitors of the PD-1:PD-L1 Interaction for Cancer Immunotherapy," J Am Chem Soc. Nov. 10, 2021;143(44):18536-18547.
Zerdes et al., "STAT3 Activity Promotes Programmed-Death Ligand 1 Expression and Suppresses Immune Responses in Breast Cancer," Cancers (Basel). Oct. 1, 2019;11(10):1479.
Zou et al., "Targeting STAT3 in Cancer Immunotherapy," Mol Cancer. Sep. 24, 2020;19(1):145.

* cited by examiner

Docosahexaenoic acid (DHA)
Eicosapentaenoic acid (EPA)
Docosanoic acid (DCA)
Stearic Acid, C18
Oleic acid, C18:1
Linoleic acid, C18:1
Palmitic acid, C16
Myrisic acid, C14
Lauric acid, C12
Decanoic acid, C10
Caprylic acid, C8

STAT3 TARGETING OLIGONUCLEOTIDES AND USES THEREOF

CROSS-RELATED APPLICATIONS

This application is a Continuation of Application No. PCT/US23/80076 filed on Nov. 16, 2023, which claims the benefit of U.S. Provisional Application No. 63/425,861 filed Nov. 16, 2022. The entire contents of these applications are incorporated herein by this reference.

REFERENCE TO ELECTRONIC SEQUENCE LISTING

The application contains a Sequence Listing which has been submitted electronically in .XML format and is hereby incorporated by reference in its entirety. Said .XML copy, created on Jun. 4, 2025, is named "DCY-12101.xml" and is 4,216,801 bytes in size. The sequence listing contained in this .XML file is part of the specification and is hereby incorporated by reference herein in its entirety.

BACKGROUND OF THE DISCLOSURE

Currently, chemotherapy is the leading cancer therapy worldwide, often combined with surgery, or surgery and radiotherapy, depending on tumor type and stage (Abbas et al., An Overview of Cancer Treatment Modalities/IntechOpen, 2018). Since the discovery of several important mutations that contribute to carcinogenesis (e.g., epidermal cell alterations (Yamaoka et al., int. j. mol. sci. (2017) 18(11): 2420)) these mutations and the proteins they represent have been extensively used as targets for the development of more selective drugs and drug combinations to treat cancer patients. Despite the effectiveness of these drugs, multidrug resistance (MDR) is often seen in patients, which often results in tumor relapse, limited therapeutic options and low quality of life for patients. In addition, cancer research has often been focused on tumor cells even though the effect of the tumor microenvironment and the 'normal' or non-cancerous cells within it that have been shown to play a key role in tumor progression, development and MDR (Klemm et al., trends cell biol (2015) 25(4): 198-213). Novel therapies that target different facets of the TME that contribute to tumor growth are needed.

BRIEF SUMMARY OF THE DISCLOSURE

The disclosure is based, in part, on the discovery of oligonucleotides that target STAT3 mRNA and reduce expression. The disclosure is further based on the discovery that a combination of a STAT3 oligonucleotide and a PD-L1 inhibitor provides synergistic anti-tumor efficacy for tumors of varying tumor microenvironments. Specifically, as demonstrated herein, a STAT3 oligonucleotide conjugated to a lipid, when delivered in combination with an anti-PD-L1 antibody, reduced tumor volume in vivo in immunosuppressive and inflamed tumor models. Further, as shown herein, the combination of a STAT3 oligonucleotide and PD-L1 inhibitor induced an anti-tumor memory response as when mice were re-challenged with cancer cells, no tumors were established. In addition, the efficacy of the STAT3 oligonucleotide and PD-L1 inhibitor was dependent on the presence of CD8+ T cells.

Accordingly, in some aspects, the disclosure provides an oligonucleotide for reducing STAT3 expression, the oligonucleotide comprising an antisense strand of 15 to 30 nucleotides in length and a sense strand of 15 to 40 nucleotides in length, wherein the sense strand and antisense strand form a duplex region, wherein the antisense strand has a region of complementarity to a target sequence of STAT3 as set forth in SEQ ID NO: 140, wherein the sense strand comprises at least one lipid moiety conjugated to the 5'terminal nucleotide of the sense strand.

In some or any of the foregoing or related aspects, the antisense strand is 19 to 27 nucleotides in length. In some aspects, the antisense strand is 21 to 27 nucleotides in length, optionally wherein the antisense strand is 22 nucleotides in length.

In some or any of the foregoing or related aspects, the sense strand is 19 to 40 nucleotides in length, optionally wherein the sense strand is 36 nucleotides in length.

In some or any of the foregoing or related aspects, the duplex region is at least 19 nucleotides in length. In some aspects, the duplex region is at least 20 nucleotides in length, optionally wherein the duplex region is 21 nucleotides in length. In some aspects, the region of complementarity to STAT3 is at least 19 contiguous nucleotides in length. In some aspects, the region of complementarity to STAT3 is at least 21 contiguous nucleotides in length.

In some or any of the foregoing or related aspects the antisense strand comprises a sequence as set forth in SEQ ID NO: 965.

In some or any of the foregoing or related aspects, the sense strand comprises a sequence as set forth in SEQ ID NO: 875.

In some or any of the foregoing or related aspects, the sense strand comprises at its 3' end a stem-loop set forth as: S1-L-S2, wherein S1 is complementary to S2, and wherein L forms a loop between S1 and S2 of 3 to 5 nucleotides in length.

In some aspects, the disclosure provides an oligonucleotide for reducing STAT3 expression, the oligonucleotide comprising an antisense strand and a sense strand, wherein the antisense strand is 21 to 27 nucleotides in length and has a region of complementarity to a target sequence of STAT3 as set forth in SEQ ID NO: 140, wherein the sense strand comprises at its 3' end a stem-loop set forth as: S1-L-S2, wherein S1 is complementary to S2, wherein L forms a loop between S1 and S2 of 3 to 5 nucleotides in length, wherein the antisense strand and the sense strand form a duplex structure of at least 19 nucleotides in length, and wherein the sense strand comprises a lipid moiety conjugated to the 5' terminal nucleotide of the sense strand.

In some aspects, the disclosure provides a double stranded oligonucleotide for reducing STAT3 expression, the oligonucleotide comprising:

(i) an antisense strand of 19-30 nucleotides in length, wherein the antisense strand comprises a nucleotide sequence comprising a region of complementarity to a STAT3 mRNA target sequence, wherein the region of complementarity is set forth in SEQ ID NO: 140, and (ii) a sense strand of 19-50 nucleotides in length comprising a region of complementarity to the antisense strand, wherein the sense strand comprises a lipid moiety conjugated to the 5' terminal nucleotide of the sense strand, wherein the antisense and sense strands are separate strands which form an asymmetric duplex region having an overhang of 1-4 nucleotides at the 3' terminus of the antisense strand.

In some or any of the foregoing or related aspects, L is a tetraloop, optionally wherein L is 4 nucleotides in length. In some aspects, L comprises a sequence set forth as GAAA.

In some or any of the foregoing or related aspects, the antisense strand is 27 nucleotides in length and the sense strand is 25 nucleotides in length, optionally wherein the antisense strand is 22 nucleotides in length and the sense strand is 36 nucleotides in length. In some aspects, the antisense strand and sense strand form a duplex region of 25 nucleotides in length, optionally wherein the duplex is 20 nucleotides in length. In some aspects, the antisense strand comprises a 3' overhang sequence of one or more nucleotides in length, optionally wherein the 3' overhang sequence is 2 nucleotides in length, optionally wherein the 3' overhang sequence is GG.

In some or any of the foregoing or related aspects, the oligonucleotide comprises at least one modified nucleotide. In some aspects, the modified nucleotide comprises a 2'-modification. In some aspects, the 2'-modification is a modification selected from 2'-aminoethyl, 2'-fluoro, 2'-O-methyl, 2'-O-methoxyethyl, and 2'-deoxy-2'-fluoro-β-d-arabinonucleic acid. In some aspects, about 10-15%, 10%, 11%, 12%, 13%, 14% or 15% of the nucleotides of the sense strand comprise a 2'-fluoro modification. In some aspects, about 25-35%, 25%, 26%, 27%, 28%, 29%, 30%, 31%, 32%, 33%, 34% or 35% of the nucleotides of the antisense strand comprise a 2'-fluoro modification. In some aspects, about 25-35%, 25%, 26%, 27%, 28%, 29%, 30%, 31%, 32%, 33%, 34% or 35% of the nucleotides of the oligonucleotide comprise a 2'-fluoro modification.

In some or any of the foregoing or related aspects, the sense strand comprises 36 nucleotides with positions 1-36 from 5' to 3', wherein positions 8-11 comprise a 2'-fluoro modification. In some aspects, the antisense strand comprises 22 nucleotides with positions 1-22 from 3' to 5', and wherein positions 2, 3, 4, 5, 7, 10 and 14 comprise a 2'-fluoro modification. In some aspects, the remaining nucleotides comprise a 2'-O-methyl modification.

In some or any of the foregoing or related aspects, the oligonucleotide comprises at least one modified internucleotide linkage. In some aspects, the at least one modified internucleotide linkage is a phosphorothioate linkage. In some aspects, the sense strand comprises a phosphorothioate linkage between positions 1 and 2 of the sense strand. In some aspects, the antisense strand comprises 22 nucleotides with positions 1-22 from 3' to 5', wherein the antisense strand comprises a phosphorothioate linkage between positions 1 and 2, 2 and 3, 3 and 4, 20 and 21, and 21 and 22. In some aspects, the sense strand comprises a phosphorothioate linkage between positions 1 and 2 of the sense strand and the antisense strand comprises 22 nucleotides with positions 1-22 from 3' to 5', wherein the antisense strand comprises a phosphorothioate linkage between positions 1 and 2, 2 and 3, 3 and 4, 20 and 21, and 21 and 22.

In some or any of the foregoing or related aspects, the 4'-carbon of the sugar of the 5'-nucleotide of the antisense strand comprises a phosphate analog. In some aspects, phosphate analog is oxymethylphosphonate, vinylphosphonate or malonylphosphonate.

In some or any of the foregoing or related aspects, the lipid moiety is a saturated or unsaturated fatty acid moiety. In some aspects, the lipid moiety is a saturated fatty acid moiety that ranges in size from C10 to C24 in length.

In some or any of the foregoing or related aspects, the lipid moiety is a C16 saturated fatty acid moiety. In some aspects, the C16 saturated fatty acid moiety is represented by:

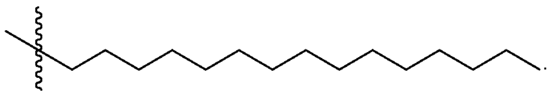 [SMILES: *CCCCCCCCCCCCCCC]

In some or any of the foregoing or related aspects, the lipid moiety is a C18 saturated fatty acid moiety. In some aspects, the C18 saturated fatty acid moiety is represented by:

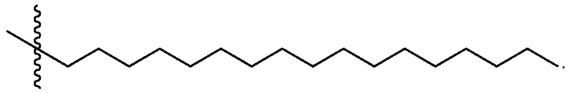 [SMILES: *CCCCCCCCCCCCCCCCC]

In some or any of the foregoing or related aspects, the lipid moiety is selected from:

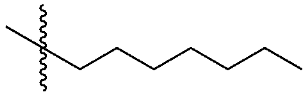 , 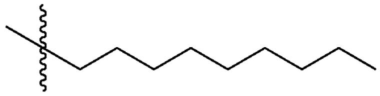 , 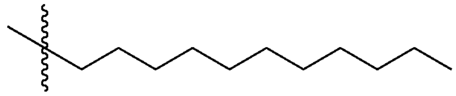 ,

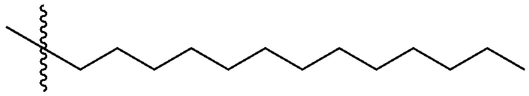 , 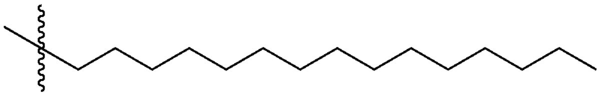 ,

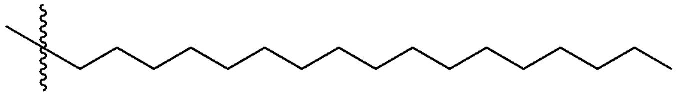 ,

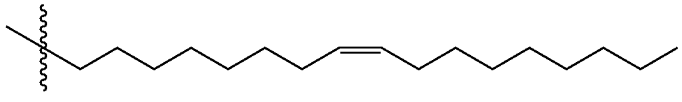 ,

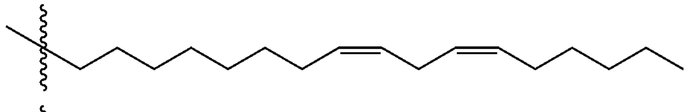 ,

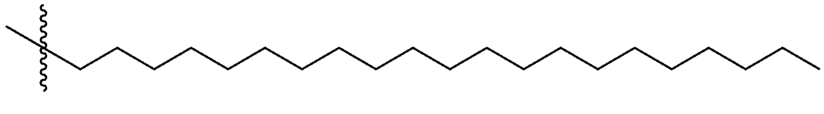 ,

-continued

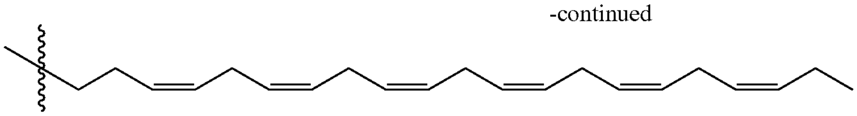
,
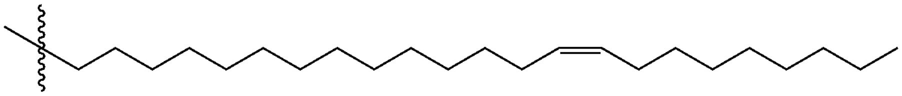
,
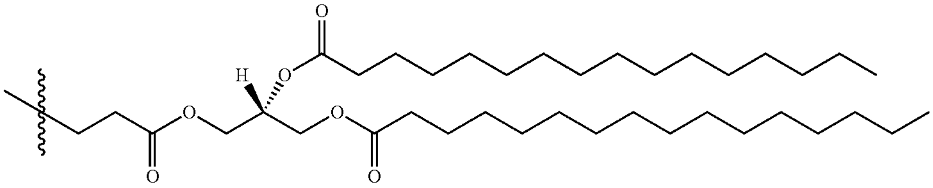
,
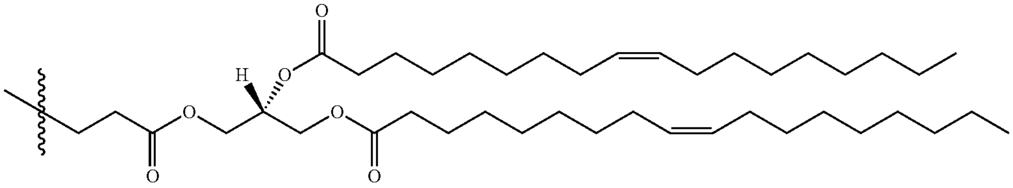
, and
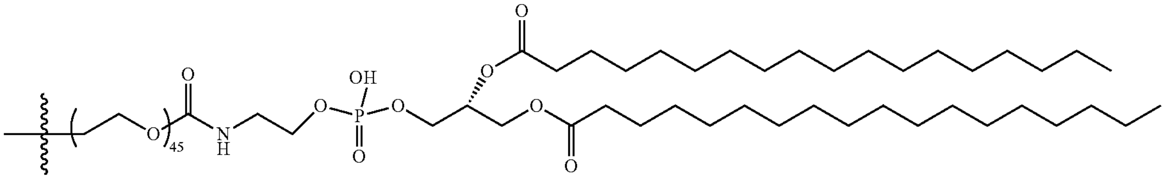
.

In some or any of the foregoing or related aspects, the lipid moiety is conjugated to the 2' carbon of the ribose ring of the 5' terminal nucleotide.

In some or any of the foregoing or related aspects, the sense strand comprises the sequence set forth in SEQ ID NO: 1222. In some aspects, the antisense strand comprises the sequence set forth in SEQ ID NO: 1145. In some or any of the foregoing or related aspects, the sense strand comprises the sequence set forth in SEQ ID NO: 1222, and wherein the antisense strand comprises the sequence set forth in SEQ ID NO: 1145.

In some aspects, the disclosure provides a double-stranded oligonucleotide for reducing STAT3 expression, wherein the oligonucleotide comprises a sense strand comprising the sequence set forth in SEQ ID NO: 1222 and the antisense strand comprises the sequence set forth in SEQ ID NO: 1145, wherein the sense strand and antisense strand form an asymmetric duplex region of 20 nucleotides in length and having an overhang of 2 nucleotides at the 3' terminus of the antisense strand.

In some or any of the foregoing or related aspects, the region of complementary is fully complementary to the STAT3 target sequence. In some aspects, the region of complementary is partially complementary to the STAT3 target sequence. In some aspects, the region of complementary comprises no more than 4 mismatches to the STAT3 target sequence. In some aspects, the region of complementary is fully complementary to the STAT3 target sequence at nucleotide positions 2-8 or 2-11 of the antisense strand, wherein nucleotide positions are numbered 5' to 3'.

In some or any of the foregoing or related aspects, the oligonucleotide is a Dicer substrate that, upon endogenous Dicer processing, yields double-stranded nucleic acids of 19-21 nucleotides in length capable of reducing STAT3 mRNA expression in a mammalian cell.

In some or any of the foregoing or related aspects, the oligonucleotide reduces expression of STAT3 mRNA in one or more immune cells associated with a tumor microenvironment.

In some aspects, the disclosure provides a pharmaceutical composition comprising an oligonucleotide of any of the foregoing or related aspects, and a pharmaceutically acceptable carrier, delivery agent, or excipient.

In some aspects, the disclosure provides a method of treating cancer in a subject, the method comprising administering to the subject an effective amount of an oligonucleotide or pharmaceutical composition of any of the foregoing or related aspects.

In some or any of the foregoing or related aspects, the PD-L1 inhibitor is administered to the subject.

In some aspects, the disclosure provides a method of treating cancer in a subject that has received or is receiving a PD-L1 inhibitor, the method comprising administering an oligonucleotide or pharmaceutical composition of any of the foregoing or related aspects to the subject, thereby treating cancer in the subject.

In some aspects, the disclosure provides a method of treating cancer in a subject that has received or is receiving an oligonucleotide targeting STAT3, wherein the oligonucleotide targeting STAT3 is an oligonucleotide or pharmaceutical composition of any of the foregoing or related aspects, the method comprising administering a PD-L1 inhibitor to the subject, thereby treating cancer in the subject.

In some aspects, the disclosure provides a method for treating a disease, disorder or condition associate with STAT3 expression in a subject, the method comprising administering to the subject an effective amount of an oligonucleotide or pharmaceutical composition of any of the foregoing or related aspects.

In some or any of the foregoing or related aspects, the PD-L1 inhibitor is administered to the subject.

In some aspects, the disclosure provides a method for treating a disease, disorder or condition associate with STAT3 expression in a subject that has received or is receiving a PD-L1 inhibitor, the method comprising administering an oligonucleotide or pharmaceutical composition of any of the foregoing or related aspects to the subject, thereby treating cancer in the subject.

In some aspects, the disclosure provides a method for treating a disease, disorder or condition associate with STAT3 expression in a subject that has received or is receiving an oligonucleotide targeting STAT3, wherein the oligonucleotide targeting STAT3 is an oligonucleotide or pharmaceutical composition of any of the foregoing or related aspects, the method comprising administering a PD-L1 inhibitor to the subject, thereby treating cancer in the subject.

In some or any of the foregoing or related aspects, the disease, disorder or condition associated with STAT3 expression is a cancer. In some aspects, the cancer is selected from carcinoma, sarcoma, melanoma, lymphoma, and leukemia, prostate cancer, breast cancer, hepatocellular carcinoma (HCC), colorectal cancer, pancreatic cancer and glioblastoma. In some aspects, the cancer comprises an immunosuppressive tumor microenvironment. In some aspects, the cancer comprises an inflamed tumor microenvironment. In some aspects, the inflamed tumor microenvironment comprises infiltrating T cells.

In some or any of the foregoing or related aspects, the PD-L1 inhibitor is an antibody. IN some aspects, the antibody is an anti-PD-L1 antibody. In some aspects, the anti-PDL1 antibody is selected from FAZ053, atezolizumab, avelumab, durvalumab, envafolimab, and BMS-936559.

In some or any of the foregoing or related aspects, the antibody is an anti-PD-1 antibody. In some aspects, the anti-PD-1 antibody is selected from nivolumab, pembrolizumab, and cemiplimab.

In some or any of the foregoing or related aspects, treating cancer comprises reducing or inhibiting tumor growth in the subject.

In some aspects, the disclosure provides a method of reducing expression of STAT3 mRNA in a cell, comprising contacting the cell with an oligonucleotide of any of the foregoing or related aspects.

In some aspects, the disclosure provides a kit comprising a container comprising the oligonucleotide of any of the foregoing or related aspects, an optional pharmaceutically acceptable carrier, and a package insert comprising instructions for administration to a subject having a disease, disorder or condition associated with STAT3 expression.

In some aspects, the disease, disorder or condition associated with STAT3 expression is a cancer.

In some aspects, the disclosure provides a kit comprising a container comprising the oligonucleotide of any of the foregoing or related aspects, an optional pharmaceutically acceptable carrier, and a package insert comprising instructions for administration to a subject with cancer that has received or is receiving a PD-L1 inhibitor.

In some aspects, the disclosure provides a kit comprising a container comprising a PD-L1 inhibitor, an optional pharmaceutically acceptable carrier, and a package insert comprising instructions for administration to a subject with cancer that has received or is receiving the oligonucleotide of any of the foregoing or related aspects.

In some aspects, the disclosure provides a kit comprising an oligonucleotide, an optional pharmaceutically acceptable carrier, and a package insert comprising instructions for administering the oligonucleotide to a subject in need thereof that has received or is receiving a PD-L1 inhibitor, wherein the oligonucleotide is the oligonucleotide of any of the foregoing or related aspects.

In some aspects, the disclosure provides a kit comprising a PD-L1 inhibitor, an optional pharmaceutically acceptable carrier, and a package insert comprising instructions for administering the inhibitor to a subject in need thereof that has received or is receiving an oligonucleotide, wherein the oligonucleotide is an oligonucleotide of any of the foregoing or related aspects.

In some or any of the foregoing or related aspects, the subject has a disease, disorder, or condition associated with activated STAT3 expression. In some aspects, the subject has cancer.

In some aspects, the disclosure provides a method of determining responsiveness in a subject with cancer who has received or is receiving a treatment, the method comprising detecting the presence of myeloid-derived suppressor cells (MDSCs) or a marker of MDSC activity in a biological sample of the subject, wherein the treatment is administration of an oligonucleotide targeting STAT3, and wherein a reduction of MDSCs or a reduction in a marker of MDSC activity in the biological sample indicates the subject is responding to the treatment.

In some aspects, the disclosure provides a method for determining responsiveness in a subject with cancer who has received or is receiving a treatment, comprising:

(i) obtaining a biological sample from the subject; and (ii) detecting of the presence of MDSCs or a marker of MDSC activity in the biological sample, wherein the treatment is administration of an oligonucleotide targeting STAT3, and wherein a reduction of MDSCs or a reduction in a marker of MDSC activity in the biological sample indicates the subject is responding to the treatment.

In some or any of the foregoing or related aspects, detecting comprises determining an amount of MDSCs or an amount of a marker of MDSC activity.

In some aspects, reduction of MDSCs or marker of MDSC activity is relative to an amount or level of MDSCs or marker of MDSC activity prior to treatment of the subject.

In some aspects, the reduction of MDSCs or marker of MDSC activity is relative to an amount or level of MDSCs or marker of MDSC activity of a population of patients that did not receive the treatment. In some aspects, the reduction of MDSCs or marker of MDSC activity is based on an amount or level of MDSCs or marker of MDSC activity of a population of patients that responded to the treatment.

In some aspects, the MDSCs are granulocytic-MDSCs (G-MDSCs). In some aspects, the MDSCs are monocytic-MDSCs (M-MDSCs). In some aspects, the MDSCs express Arg1.

In some aspects, the MDSCs express IDO. In some aspects, the presence of MDSCs or a marker of activity of MDSC is determined by flow cytometry.

In some aspects, the biological sample is a blood or serum sample.

In some aspects, responding to treatment comprises a reduction or inhibition of tumor growth and/or tumor size.

In some aspects, the oligonucleotide targeting STAT3 is the oligonucleotide of any of the foregoing or related aspects.

DETAILED DESCRIPTION

Figure 1A:
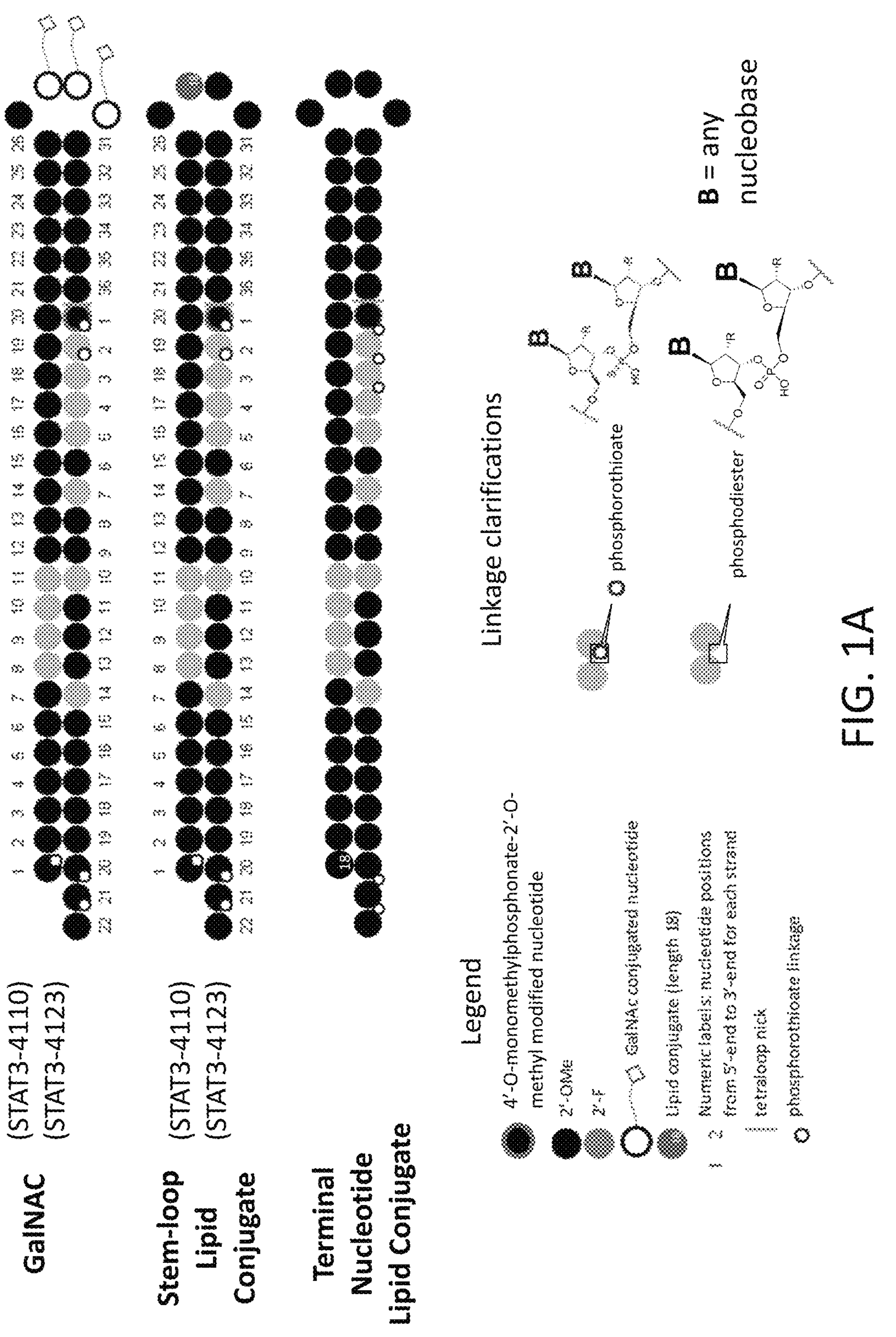
FIG. 1A provides structures of RNAi oligonucleotide molecules having chemical modifications with GalNAc or lipid (e.g., C18 hydrocarbon chain) conjugated to the oligonucleotide molecule to generate oligonucleotide-ligand conjugates.

The present disclosure now will be described more fully hereinafter with reference to the accompanying drawings, in which illustrative embodiments of the disclosure are shown. The disclosure may, however, be embodied in many different forms and should not be construed as limited to the embodiments set forth herein; rather, these embodiments are provided so that this disclosure will be thorough and complete, and will fully convey the scope of the disclosure to those skilled in the art.

Definitions

The publications discussed throughout the text are provided solely for their disclosure prior to the filing date of the present application. Nothing herein is to be construed as an admission that the inventors are not entitled to antedate such disclosure by virtue of prior disclosure.

As used herein, the term "and/or" includes any and all combinations of one or more of the associated listed items. Further, the singular forms and the articles "a", "an" and "the" are intended to include the plural forms as well, unless expressly stated otherwise. It will be further understood that the terms: includes, comprises, including and/or comprising, when used in this specification, specify the presence of stated features, integers, steps, operations, elements, and/or components, but do not preclude the presence or addition of one or more other features, integers, steps, operations, elements, components, and/or groups thereof. Further, it will be understood that when an element, including component or subsystem, is referred to and/or shown as being connected or coupled to another element, it can be directly connected or coupled to the other element or intervening elements may be present.

Unless defined otherwise, all technical and scientific terms used herein have the same meaning as commonly understood to one of ordinary skill in the art to which this disclosure belongs. Although methods and materials similar or equivalent to those described herein can be used in the practice of the disclosed methods and compositions, exemplary methods, and materials are described herein.

General texts which describe molecular biological techniques useful herein, including the use of vectors, promoters and many other relevant topics, include Berger and Kimmel, Guide to Molecular Cloning Techniques, methods in enzymology, volume 152, (Academic Press, Inc., San Diego, Calif.) ("Berger"); Sambrook et al., molecular cloning—a laboratory manual, 2d ed., Vol. 1-3, Cold Spring Harbor Laboratory, Cold Spring Harbor, 1989 ("Sambrook") and current protocols in molecular biology, F. M. Ausubel et al., eds., Current Protocols, a joint venture between Greene Publishing Associates, Inc. and John Wiley and Sons, Inc., (supplemented through 1999) ("Ausubel"). Examples of protocols sufficient to direct persons of skill through in vitro amplification methods, including the polymerase chain reaction (PCR), the ligase chain reaction (LCR), Q.beta.-replicase amplification and other RNA polymerase mediated techniques (e.g., NASBA), e.g., for the production of the homologous nucleic acids of the disclosure are found in Berger, Sambrook, and Ausubel, as well as in Mullis et al., (1987) U.S. Pat. No. 4,683,202; Innis et al., eds. (1990); PCR Protocols: A Guide to Methods and Applications (Academic Press Inc. San Diego, Calif.) ("Innis"); Arnheim and Levinson (Oct. 1, 1990) Cand EN 36-47; J. NIH Res. (1991) 3:81-94; Kwoh et al., (1989) Proc. Natl. Acad. Sci. USA 86:1173; Guatelliet et al., (1990) Proc. Nat'l. Acad. Sci. USA 87:1874; Lomell et al., (1989) J. Clin. Chem 35:1826; Landegren et al., (1988) Science 241:1077-80; Van Brunt (1990) Biotechnology 8:291-94; Wu and Wallace (1989) Gene 4:560; Barringer et al., (1990) Gene 89:117; and, Sooknanan and Malek (1995) Biotechnology 13:563-564. Improved methods for cloning in vitro amplified nucleic acids are described in Wallace et al., U.S. Pat. No. 5,426, 039. Improved methods for amplifying large nucleic acids by PCR are summarized in Cheng et al., (1994) Nature 369:684-85 and the references cited therein, in which PCR amplicons of up to 40 kb are generated.

As used in the specification and the appended claims, the singular forms "a," "an" and "the" include plural referents unless the context clearly dictates otherwise. Thus, for example, reference to "a pharmaceutical carrier" includes mixtures of two or more such carriers, and the like.

Ranges can be expressed herein as from "about" one value, and/or to "about" another value. When such a range is expressed, another embodiment includes from the one value and/or to the other value. Similarly, when values are expressed as approximations, by use of the antecedent "about," it will be understood that the value forms another embodiment. It will be further understood that the endpoints of each of the ranges are significant both in relation to the other endpoint, and independently of the other endpoint. It is also understood that there are several values disclosed herein, and that each value is also herein disclosed as "about" that value in addition to the value itself. For example, if the value "10" is disclosed, then "about 10" is also disclosed. It is also understood that when a value is disclosed that "less than or equal to" the value, "greater than or equal to the value" and possible ranges between values are also disclosed, as appropriately understood by the skilled artisan. For example, if the value "10" is disclosed the "less than or equal to 10" as well as "greater than or equal to 10" is also disclosed. It is also understood that the throughout the application, data is provided in several different formats, and that this data, represents endpoints and starting points, and ranges for any combination of the data points. For example, if a particular datapoint "10" and a particular data point 15 are disclosed, it is understood that greater than, greater than or equal to, less than, less than or equal to, and equal to 10 and 15 are considered disclosed as well as between 10 and 15. It is also understood that each unit between two particular units are also disclosed. For example, if 10 and 15 are disclosed, then 11, 12, 13, and 14 are also disclosed.

In this specification and in the claims, which follow, reference will be made to several terms which shall be defined to have the following meanings:

The term "cancer" or "tumor" includes, but is not limited to, solid tumors and blood borne tumors. These terms include diseases of the skin, tissues, organs, bone, cartilage, blood, and vessels. These terms further encompass primary and metastatic cancers.

The term "PD-1" refers to a protein found on T cells that helps keep the immune responses in check. When PD-1 is bound to another protein called PD-L1, it helps keep T cells from killing other cells, including cancer cells. Some anti-cancer drugs, called immune checkpoint inhibitors, are used to block PD-1. When this protein is prevented from acting on T cells, they can act to kill cancer cells.

The term "STAT3" refers to Signal transducer and activator of transcription 3 (STAT3) which is a transcription factor which in humans is encoded by the STAT3 gene (STAT3 Human (Hs) NM_001369512.1 Genbank RefSeq #, or NM_139276.3). STAT3 mediates the expression of a variety of genes in response to cell stimuli, and thus plays a key role in many cellular processes such as cell growth and apoptosis, as well as the growth and progression of cancer.

As used herein, the term "cold tumor" or "non-inflamed tumor" refers to a tumor or tumor microenvironment wherein there is minimal to no presence of anti-tumor immune cells, such as tumor infiltrating lymphocytes (TILs), and/or contain cell subsets associated with immune suppression including regulatory T cells (Treg), myeloid-derived suppressor cells (MDSCs) and M2 macrophages. Specifically, in some embodiments, a cold tumor is characterized by a low number or even absence of infiltration of anti-tumor immune cells that such cells may be present but remain stuck in the surrounding stroma, thus unable to colonize the tumor microenvironment to provide their antitumor functions.

As used herein, "complementary" refers to a structural relationship between two nucleotides (e.g., on two opposing nucleic acids or on opposing regions of a single nucleic acid strand) that permits the two nucleotides to form base pairs with one another. For example, a purine nucleotide of one nucleic acid that is complementary to a pyrimidine nucleotide of an opposing nucleic acid may base pair together by forming hydrogen bonds with one another. In some embodiments, complementary nucleotides can base pair in the Watson-Crick manner or in any other manner that allows for the formation of stable duplexes. In some embodiments, two nucleic acids may have regions of multiple nucleotides that are complementary with each other to form regions of complementarity, as described herein.

As used herein, "species cross-reactive oligonucleotide" refers to an oligonucleotide capable of inhibiting expression of a target mRNA in more than one species. For example, in some embodiments a species cross-reactive oligonucleotide is capable of inhibiting expression of a target mRNA in human and non-human primates. Example species include but is not limited to human, non-human primates, mouse, and rat. In some embodiments, species cross-reactive oligonucleotides are capable of targeting and inhibiting mRNA in at least two, at least three, or at least four species.

As used herein, "deoxyribonucleotide" refers to a nucleotide having a hydrogen in place of a hydroxyl at the 2' position of its pentose sugar when compared with a ribonucleotide. A modified deoxyribonucleotide is a deoxyribonucleotide having one or more modifications or substitutions of atoms other than at the 2' position, including modifications or substitutions in or of the sugar, phosphate group or base.

As used herein, "double-stranded RNA" or "dsRNA" refers to an RNA oligonucleotide that is substantially in a duplex form. In some embodiments, the complementary base-pairing of duplex region(s) of a dsRNA oligonucleotide is formed between antiparallel sequences of nucleotides of covalently separate nucleic acid strands. In some embodiments, complementary base-pairing of duplex region(s) of a dsRNA formed between antiparallel sequences of nucleotides of nucleic acid strands that are covalently linked. In some embodiments, complementary base-pairing of duplex region(s) of a dsRNA is formed from single nucleic acid strand that is folded (e.g., via a hairpin) to provide complementary antiparallel sequences of nucleotides that base pair together. In some embodiments, a dsRNA comprises two covalently separate nucleic acid strands that are fully duplexed with one another. However, in some embodiments, a dsRNA comprises two covalently separate nucleic acid strands that are partially duplexed (e.g., having overhangs at one or both ends). In some embodiments, a dsRNA comprises antiparallel sequence of nucleotides that are partially complementary, and thus, may have one or more mismatches, which may include internal mismatches or end mismatches.

As used herein, "duplex," in reference to nucleic acids (e.g., oligonucleotides), refers to a structure formed through complementary base pairing of two antiparallel sequences of nucleotides.

As used herein, "excipient" refers to a non-therapeutic agent that may be included in a composition, for example, to provide or contribute to a desired consistency or stabilizing effect.

As used herein, the term "hot tumor" or "inflamed tumor" refers to a tumor or tumor microenvironment wherein there is a considerable presence of anti-tumor immune cells especially TILs and thus are typically immuno-stimulatory.

As used herein, "loop" refers to an unpaired region of a nucleic acid (e.g., oligonucleotide) that is flanked by two antiparallel regions of the nucleic acid that are sufficiently complementary to one another, such that under appropriate hybridization conditions (e.g., in a phosphate buffer, in a cells), the two antiparallel regions, which flank the unpaired region, hybridize to form a duplex (referred to as a "stem"). The loop may refer to a loop comprising four nucleotides as a tetraloop (tetraL). The loop may refer to a loop comprising three nucleotides as a triloop (triL).

As used herein, "modified internucleotide linkage" refers to an internucleotide linkage having one or more chemical modifications when compared with a reference internucleotide linkage comprising a phosphodiester bond. In some embodiments, a modified nucleotide is a non-naturally occurring linkage. Typically, a modified internucleotide linkage confers one or more desirable properties to a nucleic acid in which the modified internucleotide linkage is present. For example, a modified nucleotide may improve thermal stability, resistance to degradation, nuclease resistance, solubility, bioavailability, bioactivity, reduced immunogenicity, etc.

As used herein, "modified nucleotide" refers to a nucleotide having one or more chemical modifications when compared with a corresponding reference nucleotide selected from: adenine ribonucleotide, guanine ribonucleotide, cytosine ribonucleotide, uracil ribonucleotide, adenine deoxyribonucleotide, guanine deoxyribonucleotide, cytosine deoxyribonucleotide and thymidine deoxyribonucleotide. In some embodiments, a modified nucleotide is a non-naturally occurring nucleotide. In some embodiments, a modified nucleotide has one or more chemical modification in its sugar, nucleobase and/or phosphate group. In some embodiments, a modified nucleotide has one or more chemical moieties conjugated to a corresponding reference nucleotide. Typically, a modified nucleotide confers one or more desirable properties to a nucleic acid in which the modified nucleotide is present. For example, a modified nucleotide may improve thermal stability, resistance to degradation, nuclease resistance, solubility, bioavailability, bioactivity, reduced immunogenicity, etc.

As used herein, "nicked tetraloop structure" refers to a structure of a RNAi oligonucleotide that is characterized by separate sense (passenger) and antisense (guide) strands, in which the sense strand has a region of complementarity with the antisense strand, and in which at least one of the strands, generally the sense strand, has a tetraloop configured to stabilize an adjacent stem region formed within the at least one strand.

As used herein, "oligonucleotide" refers to a short nucleic acid (e.g., less than about 100 nucleotides in length). An oligonucleotide may be single stranded (ss) or double-stranded (ds). An oligonucleotide may or may not have duplex regions. An oligonucleotide may comprise deoxyribonucleotides, ribonucleosides, or a combination of both. In some embodiments, a double-stranded oligonucleotide comprising ribonucleotides is referred to as "dsRNA". As a set of non-limiting examples, an oligonucleotide may be, but is not limited to, a small interfering RNA (siRNA), microRNA (miRNA), short hairpin RNA (shRNA), dicer substrate interfering RNA (dsiRNA), antisense oligonucleotide, short siRNA or ss siRNA. In some embodiments, a double-stranded RNA (dsRNA) is an RNAi oligonucleotide.

The terms "RNAi oligonucleotide conjugate" and "oligonucleotide-ligand conjugate" are used interchangeably and refer to an oligonucleotide comprising one or more nucleotides conjugated with one or more targeting ligands.

As used herein, "overhang" refers to terminal non-base pairing nucleotide(s) resulting from one strand or region extending beyond the terminus of a complementary strand with which the one strand or region forms a duplex. In some embodiments, an overhang comprises one or more unpaired nucleotides extending from a duplex region at the 5' terminus or 3' terminus of a dsRNA. In certain embodiments, the overhang is a 3' or 5' overhang on the antisense strand or sense strand of a dsRNA.

As used herein, "phosphate analog" refers to a chemical moiety that mimics the electrostatic and/or steric properties of a phosphate group. In some embodiments, a phosphate analog is positioned at the 5' terminal nucleotide of an oligonucleotide in place of a 5'-phosphate, which is often susceptible to enzymatic removal. In some embodiments, a 5' phosphate analog contains a phosphatase-resistant linkage. Examples of phosphate analogs include, but are not limited to, 5' phosphonates, such as 5' methylene phosphonate (5'-MP) and 5'-(E)-vinylphosphonate (5'-VP). In some embodiments, an oligonucleotide has a phosphate analog at a 4'-carbon position of the sugar (referred to as a "4'-phosphate analog") at a 5'-terminal nucleotide. An example of a 4'-phosphate analog is oxymethylphosphonate, in which the oxygen atom of the oxymethyl group is bound to the sugar moiety (e.g., at its 4'-carbon) or analog thereof. See, e.g., U.S. Provisional Patent Application Nos. 62/383,207 (filed on 2 Sep. 2016) and 62/393,401 (filed on 12 Sep. 2016). Other modifications have been developed for the 5' end of oligonucleotides (see, e.g., Intl. Patent Application No. WO 2011/133871; U.S. Pat. No. 8,927,513; and Prakash et al., (2015) Nucleic Acids Res. 43:2993-3011).

As used herein, "reduced expression" of a gene (e.g., STAT3) refers to a decrease in the amount or level of RNA transcript (e.g., STAT3 mRNA) or protein encoded by the gene and/or a decrease in the amount or level of activity of the gene in a cell, a population of cells, a sample, or a subject, when compared to an appropriate reference (e.g., a reference cell, population of cells, sample, or subject). For example, the act of contacting a cell with an oligonucleotide herein (e.g., an oligonucleotide comprising an antisense strand having a nucleotide sequence that is complementary to a nucleotide sequence comprising STAT3 mRNA) may result in a decrease in the amount or level of STAT3 mRNA, protein and/or activity (e.g., via degradation of STAT3 mRNA by the RNAi pathway) when compared to a cell that is not treated with the dsRNA. Similarly, and as used herein, "reducing expression" refers to an act that results in reduced expression of a gene (e.g., STAT3). As used herein, "reduction of STAT3 expression" refers to a decrease in the amount or level of STAT3 mRNA, STAT3 protein and/or STAT3 activity in a cell, a population of cells, a sample or a subject when compared to an appropriate reference (e.g., a reference cell, population of cells, sample, or subject).

As used herein, "region of complementarity" refers to a sequence of nucleotides of a nucleic acid (e.g., a dsRNA) that is sufficiently complementary to an antiparallel sequence of nucleotides to permit hybridization between the two sequences of nucleotides under appropriate hybridization conditions (e.g., in a phosphate buffer, in a cell, etc.). In some embodiments, an oligonucleotide herein comprises a targeting sequence having a region of complementary to a mRNA target sequence.

As used herein, "ribonucleotide" refers to a nucleotide having a ribose as its pentose sugar, which contains a hydroxyl group at its 2' position. A modified ribonucleotide is a ribonucleotide having one or more modifications or substitutions of atoms other than at the 2' position, including modifications or substitutions in or of the ribose, phosphate group or base.

As used herein, "RNAi oligonucleotide" refers to either (a) a dsRNA having a sense strand (passenger) and antisense strand (guide), in which the antisense strand or part of the antisense strand is used by the Argonaute 2 (Ago2) endonuclease in the cleavage of a target mRNA or (b) a ss oligonucleotide having a single antisense strand, where that antisense strand (or part of that antisense strand) is used by the Ago2 endonuclease in the cleavage of a target mRNA.

As used herein, "strand" refers to a single, contiguous sequence of nucleotides linked together through internucleotide linkages (e.g., phosphodiester linkages or phosphorothioate linkages). In some embodiments, a strand has two free ends (e.g., a 5' end and a 3' end).

As used herein, "subject" means any mammal, including mice, rabbits, non-human primates (NHP), and humans. In one embodiment, the subject is a human or NHP. Moreover, "individual" or "patient" may be used interchangeably with "subject."

As used herein, "synthetic" refers to a nucleic acid or other molecule that is artificially synthesized (e.g., using a machine (e.g., a solid-state nucleic acid synthesizer)) or that is otherwise not derived from a natural source (e.g., a cell or organism) that normally produces the molecule.

As used herein, "targeting ligand" refers to a molecule or "moiety" (e.g., a carbohydrate, amino sugar, cholesterol, polypeptide, or lipid) that selectively binds to a cognate molecule (e.g., a receptor) of a tissue or cell of interest and/or that is conjugatable to another substance for purposes of targeting the other substance to the tissue or cell of interest. For example, in some embodiments, a targeting ligand may be conjugated to an oligonucleotide for purposes of targeting the oligonucleotide to a specific tissue or cell of interest. In some embodiments, a targeting ligand selectively binds to a cell surface receptor. Accordingly, in some embodiments, a targeting ligand when conjugated to an oligonucleotide facilitates delivery of the oligonucleotide into a particular cell through selective binding to a receptor expressed on the surface of the cell and endosomal internalization by the cell of the complex comprising the oligonucleotide, targeting ligand and receptor. In some embodiments, a targeting ligand is conjugated to an oligonucleotide via a linker that is cleaved following or during cellular internalization such that the oligonucleotide is released from the targeting ligand in the cell.

As used herein, "loop", "triloop", or "tetraloop" refers to a loop that increases stability of an adjacent duplex formed by hybridization of flanking sequences of nucleotides. The increase in stability is detectable as an increase in melting temperature ($T_m$) of an adjacent stem duplex that is higher than the $T_m$ of the adjacent stem duplex expected, on average, from a set of loops of comparable length consisting of randomly selected sequences of nucleotides. For example, a loop (e.g., a tetraloop or triloop) can confer a $T_m$ of at least about 50° C., at least about 55° C., at least about 56° C., at least about 58° C., at least about 60° C., at least about 65° C. or at least about 75° C. in 10 mM $NaHPO_4$ to a hairpin comprising a duplex of at least 2 base pairs (bp) in length. In some embodiments, a loop (e.g., a tetraloop) may stabilize a bp in an adjacent stem duplex by stacking interactions. In addition, interactions among the nucleotides in a tetraloop include, but are not limited to, non-Watson-Crick base pairing, stacking interactions, hydrogen bonding and contact interactions (Cheong et al., (1990) Nature 346:680-82; Heus and Pardi (1991) Science 253:191-94). In some embodiments, a loop comprises or consists of 3 to 6 nucleotides and is typically 4 to 5 nucleotides. In certain embodiments, a loop comprises or consists of 3, 4, 5 or 6 nucleotides, which may or may not be modified (e.g., which may or may not be conjugated to a targeting moiety). In some embodiments, a tetraloop comprises or consists of 3 to 6 nucleotides and is typically 4 to 5 nucleotides. In certain embodiments, a tetraloop comprises or consists of 3, 4, 5 or 6 nucleotides, which may or may not be modified (e.g., which may or may not be conjugated to a targeting moiety). In one embodiment, a loop consisting of 4 nucleotides is a tetraloop. Any nucleotide may be used in the loop (e.g., a tetraloop) and standard IUPAC-IUB symbols for such nucleotides may be used as described in Cornish-Bowden ((1985) Nucleic Acids Res. 13:3021-3030). For example, the letter "N" may be used to mean that any base may be in that position, the letter "R" may be used to show that A (adenine) or G (guanine) may be in that position, and "B" may be used to show that C (cytosine), G (guanine), or T (thymine) may be in that position. Examples of tetraloops include the UNCG family of tetraloops (e.g., UUCG), the GNRA family of tetraloops (e.g., GAAA), and the CUUG tetraloop (Woese et al., (1990) Proc. Natl. Acad. Sci. USA 87:8467-71; Antao et al., (1991) Nucleic Acids Res. 19:5901-05). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, and the d(TNCG) family of tetraloops (e.g., d(TTCG)). (See, e.g., Nakano et al., (2002) Biochem. 41:4281-92; Shinji et al., (2000) Nippon Kagakkai Koen Yokoshu 78:731). In some embodiments, the tetraloop is contained within a nicked tetraloop structure.

As used herein, "treat" or "treating" refers to the act of providing care to a subject in need thereof, for example, by administering a therapeutic agent (e.g., an oligonucleotide herein) to the subject, for purposes of improving the health and/or well-being of the subject with respect to an existing condition (e.g., a disease, disorder) or to prevent or decrease the likelihood of the occurrence of a condition. In some embodiments, treatment involves reducing the frequency or severity of at least one sign, symptom or contributing factor of a condition (e.g., disease, disorder) experienced by a subject.

As used herein, the term "tumor microenvironment" relates to the cellular environment in which any given tumor exists, including the tumor stroma, surrounding blood vessels, immune cells, fibroblasts, other cells, signaling molecules, and the ECM. It is understood that the tumor microenvironment harbors and/or surrounds the tumor cells with which it interacts.

Methods of Use

Combination of STAT3 Oligonucleotide and PD-L1 Inhibitors

In some embodiments, the disclosure provides STAT3 oligonucleotides for use, or adaptable for use, to treat a subject (e.g., a human having a disease, disorder or condition associated with STAT3 expression) that has received or is receiving a PD-L1 inhibitor.

In some embodiments, methods described herein comprise selecting a subject having a disease, disorder or condition associated with STAT3 expression and/or PD-L1 expression or is predisposed to the same. In some instances, the methods can include selecting an individual having a marker for a disease associated with STAT3 expression and/or PD-L1 expression such as cancer or other chronic lymphoproliferative disorders.

Likewise, and as detailed herein, the methods also may include steps such as measuring or obtaining a baseline value for a marker of STAT3 expression and/or PD-L1 expression, and then comparing such obtained value to one or more other baseline values or values obtained after being administered the oligonucleotide to assess the effectiveness of treatment.

In some embodiments, the disclosure provides methods of treating a subject having, suspected of having, or at risk of developing a disease, disorder, or condition with a STAT3 oligonucleotide herein, wherein the subject has received or is receiving a PD-L1 inhibitor. In some embodiments, the disclosure provides methods of treating a subject having, suspected of having, or at risk of developing a disease, disorder, or condition with a PD-L1 inhibitor described herein, wherein the subject has received or is receiving a STAT3 oligonucleotide described herein.

In some aspects, the disclosure provides methods of treating or attenuating the onset or progression of a disease, disorder or condition associated with STAT3 expression using a STAT3 oligonucleotide herein in combination with a PD-L1 inhibitor. In other aspects, the disclosure provides methods to achieve one or more therapeutic benefits in a subject having a disease, disorder or condition associated with STAT3 expression using a STAT3 oligonucleotide herein in combination with a PD-L1 inhibitor. In some embodiments of the methods herein, the subject is treated by administering a therapeutically effective amount of a STAT3 oligonucleotide herein in combination with a PD-L1 inhibitor. In some embodiments of the methods herein, the subject is treated by administering a therapeutically effective amount of a STAT3 oligonucleotide herein to a subject that has received or is receiving a PD-L1 inhibitor. In some embodiments of the methods herein, the subject is treated by administering a therapeutically effective amount of a PD-L1 inhibitor to a subject that has received or is receiving a STAT3 oligonucleotide herein. In some embodiments, the subject is treated therapeutically. In some embodiments, the subject is treated prophylactically.

In some aspects, the disclosure provides methods of treating or attenuating the onset or progression of a disease, disorder or condition associated with STAT3 expression using a STAT3 oligonucleotide comprising a sense strand which comprises the sequence set forth in SEQ ID NO: 875, and an antisense strand which comprises the sequence set forth in SEQ ID NO: 965 in combination with a PD-L1 inhibitor. In some aspects, the disclosure provides methods of treating or attenuating the onset or progression of a disease, disorder or condition associated with STAT3 expression using a STAT3 oligonucleotide comprising a sense strand which comprises the sequence set forth in SEQ ID NO: 1222, and an antisense strand which comprises the sequence set forth in SEQ ID NO: 1145 in combination with a PD-L1 inhibitor. In other aspects, the disclosure provides methods to achieve one or more therapeutic benefits in a subject having a disease, disorder or condition associated with STAT3 expression using a STAT3 oligonucleotide comprising a sense strand which comprises the sequence set forth in SEQ ID NO: 875, and an antisense strand which comprises the sequence set forth in SEQ ID NO: 965 in combination with a PD-L1 inhibitor. In other aspects, the disclosure provides methods to achieve one or more therapeutic benefits in a subject having a disease, disorder or condition associated with STAT3 expression using a STAT3 oligonucleotide comprising a sense strand which comprises the sequence set forth in SEQ ID NO: 1222, and an antisense strand which comprises the sequence set forth in SEQ ID NO: 1145 in combination with a PD-L1 inhibitor. In some embodiments of the methods herein, the subject is treated by administering a therapeutically effective amount of a STAT3 oligonucleotide comprising a sense strand which comprises the sequence set forth in SEQ ID NO: 875, and an antisense strand which comprises the sequence set forth in SEQ ID NO: 965 in combination with a PD-L1 inhibitor. In some embodiments of the methods herein, the subject is treated by administering a therapeutically effective amount of a STAT3 oligonucleotide comprising a sense strand which comprises the sequence set forth in SEQ ID NO: 1222, and an antisense strand which comprises the sequence set forth in SEQ ID NO: 1145 in combination with a PD-L1 inhibitor. In some embodiments of the methods herein, the subject is treated by administering a therapeutically effective amount of a STAT3 oligonucleotide comprising a sense strand which comprises the sequence set forth in SEQ ID NO: 875, and an antisense strand which comprises the sequence set forth in SEQ ID NO: 965 to a subject that has received or is receiving a PD-L1 inhibitor. In some embodiments of the methods herein, the subject is treated by administering a therapeutically effective amount of a STAT3 oligonucleotide comprising a sense strand which comprises the sequence set forth in SEQ ID NO: 1222, and an antisense strand which comprises the sequence set forth in SEQ ID NO: 1145 to a subject that has received or is receiving a PD-L1 inhibitor. In some embodiments of the methods herein, the subject is treated by administering a therapeutically effective amount of a PD-L1 inhibitor to a subject that has received or is receiving a STAT3 oligonucleotide comprising a sense strand which comprises the sequence set forth in SEQ ID NO: 875, and an antisense strand which comprises the sequence set forth in SEQ ID NO: 965. In some embodiments of the methods herein, the subject is treated by administering a therapeutically effective amount of a PD-L1 inhibitor to a subject that has received or is receiving a STAT3 oligonucleotide comprising a sense strand which comprises the sequence set forth in SEQ ID NO: 1222, and an antisense strand which comprises the sequence set forth in SEQ ID NO: 1145. In some embodiments, the subject is treated therapeutically. In some embodiments, the subject is treated prophylactically.

In some embodiments of the methods herein, one or more STAT3 oligonucleotides herein, or a pharmaceutical composition comprising one or more STAT3 oligonucleotides, is administered to a subject having a disease, disorder or condition associated with STAT3 expression that has received or is receiving a PD-L1 inhibitor, such that STAT3 expression is reduced in the subject, thereby treating the subject. In some embodiments of the methods herein, a STAT3 oligonucleotide comprising a sense strand which comprises the sequence set forth in SEQ ID NO: 875, and an antisense strand which comprises the sequence set forth in SEQ ID NO: 965, or a pharmaceutical composition comprising the STAT3 oligonucleotide, is administered to a subject having a disease, disorder or condition associated with STAT3 expression that has received or is receiving a PD-L1 inhibitor, such that STAT3 expression is reduced in the subject, thereby treating the subject. In some embodiments of the methods herein, a STAT3 oligonucleotide comprising a sense strand which comprises the sequence set forth in SEQ ID NO: 1222, and an antisense strand which comprises the sequence set forth in SEQ ID NO: 1145, or a pharmaceutical composition comprising the STAT3 oligonucleotide, is administered to a subject having a disease, disorder or condition associated with STAT3 expression that has received or is receiving a PD-L1 inhibitor, such that STAT3 expression is reduced in the subject, thereby treating the subject. In some embodiments, an amount or level of STAT3 mRNA is reduced in the subject. In some embodiments, an amount or level of STAT3 and/or protein is reduced in the subject. In some embodiments of the methods herein, one or more STAT3 oligonucleotides herein, or a pharmaceutical composition comprising one or more STAT3 oligonucleotides, is administered to a subject having a disease, disorder or condition associated with STAT3 expression that has received or is receiving a PD-L1 inhibitor such that STAT3 expression and PD-L1 signaling is reduced in the subject, thereby treating the subject. In some embodiments of the methods herein, a STAT3 oligonucleotide comprising a sense strand which comprises the sequence set forth in SEQ ID NO: 875, and an antisense strand which comprises the sequence set forth in SEQ ID NO: 965, or a pharmaceutical composition comprising the STAT3 oligonucleotide, is administered to a subject having a disease, disorder or condition associated with STAT3 expression that has received or is receiving a PD-L1 inhibitor such that STAT3 expression and PD-L1 signaling is reduced in the subject, thereby treating the subject. In some embodiments of the methods herein, a STAT3 oligonucleotide comprising a sense strand which comprises the sequence set forth in SEQ ID NO: 1222, and an antisense strand which comprises the sequence set forth in SEQ ID NO: 1145, or a pharmaceutical composition comprising the STAT3 oligonucleotide, is administered to a subject having a disease, disorder or condition associated with STAT3 expression that has received or is receiving a PD-L1 inhibitor such that STAT3 expression and PD-L1 signaling is reduced in the subject, thereby treating the subject. In some embodiments, an amount or level of STAT3 mRNA and PD-L1 signaling is reduced in the subject. In some embodiments, an amount or level of STAT3 and/or protein is reduced in the subject and PD-L1 signaling is reduced in the subject.

In some embodiments, a therapeutically effective amount of a STAT3 oligonucleotide and/or PD-L1 inhibitor is administered to a subject. A therapeutically acceptable amount may be an amount that can therapeutically treat a disease or disorder. The appropriate dosage for any one subject will depend on certain factors, including the subject's size, body surface area, age, the particular composition to be administered, the active ingredient(s) in the composition, time and route of administration, general health, and other drugs being administered concurrently.

In some embodiments, a subject is administered any one of the compositions herein either enterally (e.g., orally, by gastric feeding tube, by duodenal feeding tube, via gastrostomy or rectally), parenterally (e.g., subcutaneous injection, intravenous injection or infusion, intra-arterial injection or infusion, intraosseous infusion, intramuscular injection, intracerebral injection, intracerebroventricular injection, intrathecal), topically (e.g., epicutaneous, inhalational, via eye drops, or through a mucous membrane), or by direct injection into a target organ (e.g., the liver of a subject). Typically, oligonucleotides herein are administered intravenously or subcutaneously.

As a non-limiting set of examples, the oligonucleotides herein would typically be administered quarterly (once every three months), bi-monthly (once every two months), monthly or weekly. For example, the oligonucleotides may be administered every week or at intervals of two, or three weeks. Alternatively, the oligonucleotides may be administered daily. In some embodiments, a subject is administered one or more loading doses of the oligonucleotide followed by one or more maintenance doses of the oligonucleotide.

In some embodiments, a PD-L1 inhibitor (e.g., an anti-PD-L1 antibody) herein is administered quarterly (once every three months), bi-monthly (once every two months), monthly or weekly. For example, the inhibitor is administered every week or at intervals of two, or three weeks. Alternatively, the inhibitor is administered daily.

In some embodiments the oligonucleotides herein are administered in combination with a PD-L1 inhibitor. In some embodiments the oligonucleotide and inhibitor are administered in combination concurrently, sequentially (in any order), or intermittently. For example, the oligonucleotide and inhibitor may be co-administered concurrently. Alternatively, the oligonucleotide may be administered and followed any amount of time later (e.g., one hour, one day, one week or one month) by the administration of the inhibitor, or vice versa.

In some embodiments, the subject to be treated is a human or non-human primate or other mammalian subject. Other exemplary subjects include domesticated animals such as dogs and cats; livestock such as horses, cattle, pigs, sheep, goats, and chickens; and animals such as mice, rats, guinea pigs, and hamsters.

Cancers

In some embodiments, the STAT3 oligonucleotide and PD-L1 inhibitor target are used to treat a cancer or a tumor. In some embodiments, the tumor is a primary tumor. In some embodiments, the tumor is a metastatic tumor. In some embodiments, the tumor is a refractory tumor. In some embodiments, the tumor is a Stage I, Stage II, Stage III, or Stage IV tumor. In some embodiments, the tumor is a solid-tumor. Solid-tumors refer to conditions where the cancer forms a mass In some embodiments, the cancer is a thyroid cancer, papillary thyroid carcinoma, head and neck cancer, liver cancer, colorectal cancer, pancreatic cancer, breast cancer, ovarian cancer, lung cancer, carcinoma, blastoma, medulloblastoma, retinoblastoma, sarcoma, liposarcoma, synovial cell sarcoma, neuroendocrine tumors, carcinoid tumors, gastrinoma, islet cell cancer, mesothelioma, schwannoma, acoustic neuroma, meningioma, adenocarcinoma, lymphoid malignancies, squamous cell cancer, epithelial squamous cell cancer, small-cell lung cancer (SCLC), non-small cell lung cancer (NSCLC), adenocarcinoma of the lung, squamous carcinoma of the lung, cancer of the peritoneum, hepatocellular cancer, gastric or stomach cancer, gastrointestinal cancer, glioblastoma, cervical cancer, bladder cancer, hepatoma, metastatic breast cancer, colon cancer, rectal cancer, endometrial or uterine carcinoma, salivary gland carcinoma, kidney or renal cancer, prostate cancer, vulval cancer, hepatic carcinoma, anal carcinoma, penile carcinoma, Merkel cell cancer, testicular cancer, esophageal cancer, or tumors of the biliary tract. In some embodiments, the cancer is refractory to anti-PD1, anti-PDL1 and/or anti-CTLA4 therapy. In some embodiments, the cancer is a pancreatic cancer or lung cancer. In some embodiments, the cancer comprises tumors with immunosuppressive tumor microenvironments. In some embodiments, the cancer is resistant to immune checkpoint therapy. In some embodiments, the cancer is partially resistant to immune checkpoint therapy. In some embodiments, the cancer is sensitive to immune checkpoint therapy.

In some embodiments, the STAT3 oligonucleotide and PD-L1 inhibitor reduces tumor volume. Tumor volume is measured using methods know to one of skill in the art. For example, extracted tumors are measured manually using calipers. Other methods include imagine methods such as ultrasound and MRI. In some embodiments, the oligonucleotide conjugate reduces tumor volume by at least 5%, at least 10%, at least 20%, at least 30%, at least 40%, at least 50%, at least 60%, at least 70%, at least 80%, or at least 90% compared to an untreated tumor.

Treatment Response

In some embodiments, the disclosure provides a method of monitoring treatment response in a subject. In some embodiments, treatment comprises any of the STAT3 targeting oligonucleotides described herein. In some embodiments, treatment comprises any of the STAT3 targeting oligonucleotides described herein in combination with a PD-L1 inhibitor.

In some embodiments, the disclosure provides a method of monitoring treatment response in a subject having a tumor, the method comprising detecting an amount of myeloid-derived suppressor cells (MDSCs) in a biological sample of a subject that has received or is receiving treatment with an oligonucleotide targeting STAT3 for treating a tumor in the subject, wherein a reduced amount of MDSCs in the biological sample indicates the subject is responding to treatment with the oligonucleotide.

In some embodiments, the disclosure provides a method for monitoring treatment response in a subject having a tumor, comprising:

(i) obtaining a biological sample from a subject that has received or is receiving treatment with an oligonucleotide targeting STAT3;

(ii) detecting an amount of MDSCs in the biological sample; and (iii) comparing the amount of MDSCs in the biological sample to a pre-determined amount of MDSCs, wherein a reduced amount of MDSCs in the biological sample indicates the subject is responding to treatment with the oligonucleotide.

In some embodiments, the disclosure provides a method of determining responsiveness to treatment in a subject with cancer. In some embodiments, treatment comprises any of the STAT3 targeting oligonucleotides described herein. In some embodiments, treatment comprises any of the STAT3 targeting oligonucleotides described herein in combination with a PD-L1 inhibitor.

In some embodiments, the disclosure provides a method of determining responsiveness in a subject with cancer who has received or is receiving a treatment, the method comprising detecting the presence of myeloid-derived suppressor cells (MDSCs) or a marker of MDSC activity in a biological sample of a subject. In some embodiments, a method of determining responsiveness in a subject with cancer who has received or is receiving a treatment, the method comprising detecting the presence of myeloid-derived suppressor cells (MDSCs) or a marker of MDSC activity in a biological sample of a subject, wherein the treatment is administration of an oligonucleotide targeting STAT3, and wherein a reduction of MDSCs or a reduction in a marker of MDSC activity in the biological sample indicates the subject is responding to the treatment.

In some embodiments, the disclosure provides a method for determining responsiveness in a subject with cancer who has received or is receiving a treatment, comprising:

(i) obtaining a biological sample from the subject; and (ii) detecting of the presence of MDSCs or a marker of MDSC activity in the biological sample wherein the treatment is administration of an oligonucleotide targeting STAT3, and wherein a reduction of MDSCs or a reduction in a marker of MDSC activity in the biological sample indicates the subject is responding to the treatment.

In some embodiments, the detecting comprising determining an amount of MDSCs or an amount of a marker of MDSC activity. In some embodiments, the reduction of MDSCs or marker of MDSC activity is relative to an amount or level of MDSCs or marker of MDSC activity prior to treatment of the subject. In some embodiments, the reduction of MDSCs or marker of MDSC activity is relative to an amount or level of MDSCs or marker of MDSC activity prior to treatment of the subject. In some embodiments, the reduction of MDSCs or marker of MDSC activity is relative to an amount of level of MDSCs or marker of MDSC activity of a population of patients that responded to the treatment.

In some embodiments, the pre-determined amount of MDSCs is an amount of MDSCs detected in a subject prior to treatment with an oligonucleotide. In some embodiments, the pre-determined amount of MDSCs is an average amount of MDSCs based on a population of patients that did not receive treatment with an oligonucleotide. In some embodiments, the population of patients is a healthy population of patients. In some embodiments, the population of patients is a population without cancer. In some embodiments, the population of patients is a population receiving treatment with a placebo oligonucleotide. In some embodiments, the population of patients is a population of patients that received treatment with an oligonucleotide and had a reduction or inhibition of tumor growth and/or tumor size.

In some embodiments, the MDSCs are granulocytic-MDSCs (G-MDSCs). In some embodiments, the MDSCs are monocytic-MDSCs (M-MDSCs). In some embodiments, the MDSCs express Arg1. In some embodiments, the MDSCs express IDO. In some embodiments, the MDSCs are Arg1+M-MDSCs. In some embodiments, the MDSCs are Arg1+G-MDSCs. In some embodiments, the MDSCs are IDO+M-MDSCs. In some embodiments, the MDSCs are IDO+G-MDSCs. In some embodiments, the MDSCs are G-MDSCs, M-MDSCs, Arg1+M-MDSCs, Arg1+G-MDSCs, IDO+M-MDSCs, IDO+G-MDSCs, or a combination thereof.

In some embodiments, the amount of MDSCs is determined using methods known to those of skill in the art. In some embodiments, the amount of MDSCs is determined using flow cytometry.

In some embodiments, the MDSCs are measured from a biological sample. In some embodiments, the biological sample is a blood sample. In some embodiments, the biological sample is a serum sample.

In some embodiments, responding to treatment comprises a reduction or inhibition in tumor growth and/or tumor size. In some embodiments, responding to treatment comprises a reduction or inhibition in tumor growth. In some embodiments, responding to treatment comprises a reduction or inhibition in tumor size.

In some embodiments, a method of determining responsiveness in a subject with cancer who has received or is receiving a treatment, the method comprising detecting the presence of myeloid-derived suppressor cells (MDSCs) or a marker of MDSC activity in a biological sample of a subject, wherein the treatment is administration of an oligonucleotide targeting STAT3, wherein a reduction of MDSCs or a reduction in a marker of MDSC activity in the biological sample indicates the subject is responding to the treatment, and wherein the oligonucleotide targeting STAT3 comprises a sense strand comprising a sequence selected from SEQ ID NOs: 857-946 and an antisense strand comprising a sequence selected from SEQ ID NOs: 947-1036.

In some embodiments, a method of determining responsiveness in a subject with cancer who has received or is receiving a treatment, the method comprising detecting the presence of myeloid-derived suppressor cells (MDSCs) or a marker of MDSC activity in a biological sample of a subject, wherein the treatment is administration of an oligonucleotide targeting STAT3, wherein a reduction of MDSCs or a reduction in a marker of MDSC activity in the biological sample indicates the subject is responding to the treatment, and wherein the oligonucleotide targeting STAT3 comprises a sense strand comprising a sequence selected from SEQ ID NOs: 1037-1126 and an antisense strand comprising a sequence selected from SEQ ID NOs: 1127-1216.

In some embodiments, a method of determining responsiveness in a subject with cancer who has received or is receiving a treatment, the method comprising detecting the presence of myeloid-derived suppressor cells (MDSCs) or a marker of MDSC activity in a biological sample of a subject, wherein the treatment is administration of an oligonucleotide targeting STAT3, wherein a reduction of MDSCs or a reduction in a marker of MDSC activity in the biological sample indicates the subject is responding to the treatment, and wherein the oligonucleotide targeting STAT3 comprises a sense strand comprising a sequence selected from SEQ ID NOs: 9, 37, 65, and 69 and an antisense strand comprising a sequence selected from SEQ ID NOs: 10, 38, 66, and 70.

In some embodiments, a method of determining responsiveness in a subject with cancer who has received or is receiving a treatment, the method comprising detecting the presence of myeloid-derived suppressor cells (MDSCs) or a marker of MDSC activity in a biological sample of a subject, wherein the treatment is administration of an oligonucleotide targeting STAT3, wherein a reduction of MDSCs or a reduction in a marker of MDSC activity in the biological sample indicates the subject is responding to the treatment, and wherein the oligonucleotide targeting STAT3 comprises a sense strand comprising a sequence selected from SEQ ID NOs: 11, 39, 67, and 71 and an antisense strand comprising a sequence selected from SEQ ID NOs: 12, 40, 68, and 72.

In some embodiments, a method of determining responsiveness in a subject with cancer who has received or is receiving a treatment, the method comprising detecting the presence of myeloid-derived suppressor cells (MDSCs) or a marker of MDSC activity in a biological sample of a subject, wherein the treatment is administration of an oligonucleotide targeting STAT3, wherein a reduction of MDSCs or a reduction in a marker of MDSC activity in the biological sample indicates the subject is responding to the treatment, and wherein the oligonucleotide targeting STAT3 comprises a sense strand comprising a sequence selected from SEQ ID NOs: 9, 37, 65, and 69 and an antisense strand comprising a sequence selected from SEQ ID NOs: 10, 38, 66, 70.

In some embodiments, a method of determining responsiveness in a subject with cancer who has received or is receiving a treatment, the method comprising detecting the presence of myeloid-derived suppressor cells (MDSCs) or a marker of MDSC activity in a biological sample of a subject, wherein the treatment is administration of an oligonucleotide targeting STAT3, wherein a reduction of MDSCs or a reduction in a marker of MDSC activity in the biological sample indicates the subject is responding to the treatment, and wherein the oligonucleotide targeting STAT3 comprises a sense strand comprising SEQ ID NO: 875 and an antisense strand comprising SEQ ID NO: 965.

In some embodiments, a method of determining responsiveness in a subject with cancer who has received or is receiving a treatment, the method comprising detecting the presence of myeloid-derived suppressor cells (MDSCs) or a marker of MDSC activity in a biological sample of a subject, wherein the treatment is administration of an oligonucleotide targeting STAT3, wherein a reduction of MDSCs or a reduction in a marker of MDSC activity in the biological sample indicates the subject is responding to the treatment, and wherein the oligonucleotide targeting STAT3 comprises a sense strand comprising SEQ ID NO: 1145 and an antisense strand comprising SEQ ID NO: 1222.

In some embodiments, the disclosure provides a method for determining responsiveness in a subject with cancer who has received or is receiving a treatment, comprising:

(i) obtaining a biological sample from the subject; and (ii) detecting of the presence of MDSCs or a marker of MDSC activity in the biological sample wherein the treatment is administration of an oligonucleotide targeting STAT3 comprising a sense strand comprising a sequence selected from SEQ ID NOs: 857-946 and an antisense strand comprising a sequence selected from SEQ ID NOs: 947-1036, and wherein a reduction of MDSCs or a reduction in a marker of MDSC activity in the biological sample indicates the subject is responding to the treatment.

In some embodiments, the disclosure provides a method for determining responsiveness in a subject with cancer who has received or is receiving a treatment, comprising:

(i) obtaining a biological sample from the subject; and (ii) detecting of the presence of MDSCs or a marker of MDSC activity in the biological sample wherein the treatment is administration of an oligonucleotide targeting STAT3 comprising a sense strand comprising a sequence selected from SEQ ID NOs: 1037-1126 and an antisense strand comprising a sequence selected from SEQ ID NOs: 1127-1216, and wherein a reduction of MDSCs or a reduction in a marker of MDSC activity in the biological sample indicates the subject is responding to the treatment.

In some embodiments, the disclosure provides a method for determining responsiveness in a subject with cancer who has received or is receiving a treatment, comprising:

(i) obtaining a biological sample from the subject; and (ii) detecting of the presence of MDSCs or a marker of MDSC activity in the biological sample wherein the treatment is administration of an oligonucleotide targeting STAT3 comprising a sense strand comprising a sequence selected from SEQ ID NOs: 11, 39, 67, and 71 and an antisense strand comprising a sequence selected from SEQ ID NOs: 12, 40, 68, and 72, and wherein a reduction of MDSCs or a reduction in a marker of MDSC activity in the biological sample indicates the subject is responding to the treatment.

In some embodiments, the disclosure provides a method for determining responsiveness in a subject with cancer who has received or is receiving a treatment, comprising:

(i) obtaining a biological sample from the subject; and (ii) detecting of the presence of MDSCs or a marker of MDSC activity in the biological sample wherein the treatment is administration of an oligonucleotide targeting STAT3 comprising a sense strand comprising a sequence selected from SEQ ID NOs: 9, 37, 65, and 69 and an antisense strand comprising a sequence selected from SEQ ID NOs: 10, 38, 66, 70, and wherein a reduction of MDSCs or a reduction in a marker of MDSC activity in the biological sample indicates the subject is responding to the treatment.

In some embodiments, the disclosure provides a method for determining responsiveness in a subject with cancer who has received or is receiving a treatment, comprising:

(i) obtaining a biological sample from the subject; and (ii) detecting of the presence of MDSCs or a marker of MDSC activity in the biological sample wherein the treatment is administration of an oligonucleotide targeting STAT3 comprising a sense strand comprising SEQ ID NO: 875 and an antisense strand comprising SEQ ID NO: 965, and wherein a reduction of MDSCs or a reduction in a marker of MDSC activity in the biological sample indicates the subject is responding to the treatment.

In some embodiments, the disclosure provides a method for determining responsiveness in a subject with cancer who has received or is receiving a treatment, comprising:

(i) obtaining a biological sample from the subject; and (ii) detecting of the presence of MDSCs or a marker of MDSC activity in the biological sample wherein the treatment is administration of an oligonucleotide targeting STAT3 comprising a sense strand comprising SEQ ID NO: 1145 and an antisense strand comprising SEQ ID NO: 1222, and wherein a reduction of MDSCs or a reduction in a marker of MDSC activity in the biological sample indicates the subject is responding to the treatment.

Oligonucleotide Inhibitors of STAT3

In some aspects, the disclosure provides, inter alia, oligonucleotides that reduce or inhibit STAT3 expression. In some embodiments, an oligonucleotide that inhibits STAT3 expression herein is targeted to a STAT3 mRNA. The sequence of human STAT3 mRNA (NM_001369512.1) is set forth as SEQ ID NO: 85 or NM_139276.3 (SEQ ID NO: 1217). STAT3 is a known target for conventional cancer therapies.

The tolerogenic activities of MDSCs are controlled by an oncogenic transcription factor, signal transducer and activator of transcription 3 (STAT3) (Su et al., Int J. Mol Sci (2018) 19(6): 1803). STAT3 is also known to be highly expressed across a range of cancer types and in in vitro and in vivo preclinical models (Huynh et al., nat. rev. cancer (2019) 19:82-96). The inhibition of STAT3 leads to the selective apoptosis of tumor cells and tumor growth inhibition through modulation of downstream target genes (Wang et al., International Journal of Biological Sciences, 15 (3): 668-79 (2019)). STAT3 is of particular interest in immuno-oncology due to its well documented contributions to an immunosuppressive tumor microenvironment. STAT3 contributes to an immunosuppressive tumor microenvironment by upregulating the inhibitory receptor expressed by T-cells, and via expression of its ligand (PD-1/PD-L1), through increased secretion of IFNγ ((Bu et al., Journal of Dental Research, 96(9): 1027-34 (2017)). It has long been known that inhibition of STAT3 signaling in antigen presenting cells (APCs) results in priming of antigen-specific CD4+ T cells in response to otherwise tolerogenic stimuli (Cheng et al., IMMUNITY, 19:425-36 (2003)). In addition, phosphorylated STAT3 on MDSCs directly contributes to the modulation of the suppressive tumor microenvironment by regulating suppressive components such as the amino acid arginine, through transcriptional control (Vasques-Dunndel et al., J. CLIN. INVEST., 15(3): 668-79 (2013)). Over the years several methodologies have been explored to therapeutically target STAT3. While direct targeting of the protein is attractive, the true target is a protein-protein interaction that has been held up as an example of an 'undruggable' target due historical data showing that multiple classes of compounds have failed to effectively inhibit its activity (Lau et al., CANCERS (2019) 11(11): 1681, Zou et al., MOL CANCER (2020) 19:145). In addition, ubiquitous expression of STAT3 across several tissues have led to concerns about severe on-target toxicities (Wong et al., EXPERT OPINION ON INVESTIGATIONAL DRUGS, 26 (8): 883-87 (2017), (Kortylewski et al., CANCER IMMUNOL IMMUNOTHER (2017) 66 (8): 979-88).

In some embodiments, reduction of STAT3 expression can be determined by an appropriate assay or technique to evaluate one or more properties or characteristics of a cell or population of cells associated with STAT3 expression (e.g., using an STAT3 expression biomarker) or by an assay or technique that evaluates molecules that are directly indicative of STAT3 expression (e.g., STAT3 mRNA or STAT3 protein). In some embodiments, the extent to which an oligonucleotide herein reduces STAT3 expression is evaluated by comparing STAT3 expression in a cell or population of cells contacted with the oligonucleotide to an appropriate control (e.g., an appropriate cell or population of cells not contacted with the oligonucleotide or contacted with a control oligonucleotide). In some embodiments, an appropriate control level of mRNA expression into protein, after delivery of a RNAi molecule may be a predetermined level or value, such that a control level need not be measured every time. The predetermined level or value can take a variety of forms. In some embodiments, a predetermined level or value can be single cut-off value, such as a median or mean.

In some embodiments, administration of an oligonucleotide herein results in a reduction in STAT3 expression in a cell or population of cells. In some embodiments, the reduction in STAT3 or STAT3 expression is about 1% or lower, about 5% or lower, about 10% or lower, about 15% or lower, about 20% or lower, about 25% or lower, about 30% or lower, about 35% or lower, about 40% or lower, about 45% or lower, about 50% or lower, about 55% or lower, about 60% or lower, about 70% or lower, about 80% or lower, or about 90% or lower when compared with an appropriate control level of mRNA. The appropriate control level may be a level of mRNA expression and/or protein translation in a cell or population of cells that has not been contacted with an oligonucleotide herein. In some embodiments, the effect of delivery of an oligonucleotide to a cell according to a method herein is assessed after a finite period. For example, levels of mRNA may be analyzed in a cell at least about 8 hours, about 12 hours, about 18 hours, about 24 hours; or at least about 1, 2, 3, 4, 5, 6, 7 or even up to 14 days after introduction of the oligonucleotide into the cell.

In some embodiments, an oligonucleotide is delivered in the form of a transgene that is engineered to express in a cell the oligonucleotide or strands comprising the oligonucleotide (e.g., its sense and antisense strands). In some embodiments, an oligonucleotide is delivered using a transgene engineered to express any oligonucleotide disclosed herein. Transgenes may be delivered using viral vectors (e.g., adenovirus, retrovirus, vaccinia virus, poxvirus, adeno-associated virus, or herpes simplex virus) or non-viral vectors (e.g., plasmids or synthetic mRNAs). In some embodiments, transgenes can be injected directly to a subject.

STAT3 Target Sequences

In some embodiments, the oligonucleotide is targeted to a target sequence comprising a STAT3 mRNA. In some embodiments, the oligonucleotide, or a portion, fragment, or strand thereof (e.g., an antisense strand or a guide strand of a dsRNA) binds or anneals to a target sequence comprising a STAT3 mRNA, thereby inhibiting STAT3 expression. In some embodiments, the oligonucleotide is targeted to a STAT3 target sequence for the purpose of inhibiting STAT3 expression in vivo. In some embodiments, the amount or extent of inhibition of STAT3 expression by an oligonucleotide targeted to a STAT3 target sequence correlates with the potency of the oligonucleotide. In some embodiments, the amount or extent of inhibition of STAT3 expression by an oligonucleotide targeted to a STAT3 target sequence correlates with the amount or extent of therapeutic benefit in a subject or patient having a disease, disorder or condition associated with the expression of STAT3 treated with the oligonucleotide.

Through examination of the nucleotide sequence of mRNAs encoding STAT3, including mRNAs of multiple different species (e.g., human, cynomolgus monkey, mouse, and rat; see, e.g., Example 6) and as a result of in vitro and in vivo testing (see, e.g., Example 7 and Example 8), it has been discovered that certain nucleotide sequences of STAT3 mRNA are more amenable than others to oligonucleotide-based inhibition and are thus useful as target sequences for the oligonucleotides herein. In some embodiments, a sense strand of an oligonucleotide (e.g., a dsRNA) described herein comprises a STAT3 target sequence. In some embodiments, a portion or region of the sense strand of a dsRNA described herein comprises a STAT3 target sequence. In some embodiments, a STAT3 mRNA target sequence comprises, or consists of, a sequence of SEQ ID NO 85. In some embodiments, a STAT3 mRNA target sequence comprises, or consists of, a sequence of SEQ ID NO: 1217. In some embodiments, a STAT3 mRNA target sequence comprises, or consists of, the sequence set forth in SEQ ID NO: 140.

STAT3 Targeting Sequences

In some embodiments, the oligonucleotides herein have regions of complementarity to STAT3 mRNA (e.g., within a target sequence of STAT3 mRNA) for purposes of targeting the mRNA in cells and reducing or inhibiting its expression. In some embodiments, the oligonucleotides herein comprise a STAT3 targeting sequence (e.g., an antisense strand or a guide strand of a dsRNA) having a region of complementarity that binds or anneals to a STAT3 target sequence by complementary (Watson-Crick) base pairing. The targeting sequence or region of complementarity is generally of a suitable length and base content to enable binding or annealing of the oligonucleotide (or a strand thereof) to a STAT3 mRNA for purposes of inhibiting its expression. In some embodiments, the targeting sequence or region of complementarity is at least about 12, at least about 13, at least about 14, at least about 15, at least about 16, at least about 17, at least about 18, at least about 19, at least about 20, at least about 21, at least about 22, at least about 23, at least about 24, at least about 25, at least about 26, at least about 27, at least about 28, at least about 29 or at least about 30 nucleotides in length. In some embodiments, the targeting sequence or region of complementarity is about 12 to about 30 (e.g., 12 to 30, 12 to 22, 15 to 25, 17 to 21, 18 to 27, 19 to 27, or 15 to 30) nucleotides in length. In some embodiments, the targeting sequence or region of complementarity is about 12, 13, 14, 15, 16, 17, 18, 19, 20, 21, 22, 23, 24, 25, 26, 27, 28, 29 or 30 nucleotides in length. In some embodiments, the targeting sequence or region of complementarity is 18 nucleotides in length. In some embodiments, the targeting sequence or region of complementarity is 19 nucleotides in length. In some embodiments, the targeting sequence or region of complementarity is 20 nucleotides in length. In some embodiments, the targeting sequence or region of complementarity is 21 nucleotides in length. In some embodiments, the targeting sequence or region of complementarity is 22 nucleotides in length. In some embodiments, the targeting sequence or region of complementarity is 23 nucleotides in length. In some embodiments, the targeting sequence or region of complementarity is 24 nucleotides in length. In some embodiments, an oligonucleotide comprises a target sequence or region of complementarity complementary to the sequence of SEQ ID NO: 140, and the targeting sequence or region of complementarity is 18 nucleotides in length. In some embodiments, an oligonucleotide comprises a target sequence or region of complementarity complementary to the sequence of SEQ ID NO: 140, and the targeting sequence or region of complementarity is 19 nucleotides in length. In some embodiments, an oligonucleotide comprises a target sequence or region of complementarity complementary to the sequence of SEQ ID NOs: 524, and the targeting sequence or region of complementarity is 20 nucleotides in length. In some embodiments, an oligonucleotide comprises a targeting sequence or region of complementarity complementary to the sequence of SEQ ID NO: 524, and the targeting sequence or region of complementarity is 21 nucleotides in length. In some embodiments, an oligonucleotide comprises a targeting sequence or region of complementarity complementary to the sequence of SEQ ID NO: 524, and the targeting sequence or region of complementarity is 22 nucleotides in length. In some embodiments, an oligonucleotide comprises a targeting sequence or region of complementarity complementary to the sequence of SEQ ID NO: 524, and the targeting sequence or region of complementarity is 23 nucleotides in length. In some embodiments, an oligonucleotide comprises a targeting sequence or region of complementarity complementary to the sequence of SEQ ID NO: 524 and the targeting sequence or region of complementarity is 24 nucleotides in length.

In some embodiments, an oligonucleotide herein comprises a targeting sequence or a region of complementarity (e.g., an antisense strand or a guide strand of a double-stranded oligonucleotide) that is fully complementary to a STAT3 target sequence. In some embodiments, the targeting sequence or region of complementarity is partially complementary to a STAT3 target sequence. In some embodiments, the oligonucleotide comprises a targeting sequence or region of complementarity that is fully complementary to a sequence of STAT3 or STAT3. In some embodiments, the oligonucleotide comprises a targeting sequence or region of complementarity that is partially complementary to a sequence of STAT3 or STAT3.

In some embodiments, the oligonucleotide comprises a targeting sequence or region of complementarity that is fully complementary to the sequence of SEQ ID NOs: 140. In some embodiments, the oligonucleotide comprises a targeting sequence or region of complementarity that is partially complementary to the sequence SEQ ID NO: 140.

In some embodiments, the oligonucleotide herein comprises a targeting sequence or region of complementarity that is complementary to a contiguous sequence of nucleotides comprising a STAT3 mRNA, wherein the contiguous sequence of nucleotides is about 12 to about 30 nucleotides in length (e.g., 12 to 30, 12 to 28, 12 to 26, 12 to 24, 12 to 20, 12 to 18, 12 to 16, 14 to 22, 16 to 20, 18 to 20 or 18 to 19 nucleotides in length). In some embodiments, the oligonucleotide comprises a targeting sequence or region of complementarity that is complementary to a contiguous sequence of nucleotides comprising a STAT3 mRNA, wherein the contiguous sequence of nucleotides is 10, 11, 12, 13, 14, 15, 16, 17, 18, 19 or 20 nucleotides in length. In some embodiments, the oligonucleotide comprises a targeting sequence or region of complementarity that is complementary to a contiguous sequence of nucleotides comprising a STAT3 mRNA, wherein the contiguous sequence of nucleotides is 19 nucleotides in length.

In some embodiments, an oligonucleotide herein (e.g., an RNAi oligonucleotide) comprises a targeting sequence or a region of complementary that is complementary to a contiguous sequence of nucleotides of SEQ ID NO: 140, optionally wherein the contiguous sequence of nucleotides is 19 nucleotides in length. In some embodiments, the oligonucleotide comprises a targeting sequence or a region of complementary that is complementary to a contiguous sequence of nucleotides of SEQ ID NO: 524, wherein the contiguous sequence of nucleotides is 20 nucleotides in length.

In some embodiments, a targeting sequence or region of complementarity of an oligonucleotide that is complementary to contiguous nucleotides of STAT3 or STAT3 target sequence spans the entire length of an antisense strand. In some embodiments, a region of complementarity of an oligonucleotide that is complementary to contiguous nucleotides of STAT3 or STAT3 target sequence spans a portion of the entire length of an antisense strand. In some embodiments, an oligonucleotide herein comprises a region of complementarity (e.g., on an antisense strand of a dsRNA) that is at least partially (e.g., fully) complementary to a contiguous stretch of nucleotides spanning nucleotides 1-20 of a target sequence of STAT3 or STAT3.

In some embodiments, a targeting sequence or region of complementarity of an oligonucleotide herein (e.g., an RNAi oligonucleotide) is complementary to a contiguous sequence of nucleotides of SEQ ID NO: 140 and spans the entire length of an antisense strand. In some embodiments, a targeting sequence or region of complementarity of the oligonucleotide is complementary to a contiguous sequence of nucleotides of SEQ ID NO: 140 and spans a portion of the entire length of an antisense strand. In some embodiments, an oligonucleotide herein (e.g., an RNAi oligonucleotide) comprises a region of complementarity (e.g., on an antisense strand of a dsRNA) that is at least partially (e.g., fully) complementary to a contiguous stretch of nucleotides spanning nucleotides 1-19 or 1-20 of a sequence as set forth in SEQ ID NO: 524.

In some embodiments, an oligonucleotide herein comprises a targeting sequence or region of complementarity having one or more bp mismatches with the corresponding STAT3 target sequence. In some embodiments, the targeting sequence or region of complementarity may have up to about 1, up to about 2, up to about 3, up to about 4, up to about 5, etc. mismatches with the corresponding STAT3 target sequence provided that the ability of the targeting sequence or region of complementarity to bind or anneal to the STAT3 mRNA under appropriate hybridization conditions and/or the ability of the oligonucleotide to inhibit STAT3 expression is maintained. Alternatively, the targeting sequence or region of complementarity may have no more than 1, no more than 2, no more than 3, no more than 4, or no more than 5 mismatches with the corresponding STAT3 target sequence provided that the ability of the targeting sequence or region of complementarity to bind or anneal to the STAT3 mRNA under appropriate hybridization conditions and/or the ability of the oligonucleotide to inhibit STAT3 expression is maintained. In some embodiments, the oligonucleotide comprises a targeting sequence or region of complementarity having 1 mismatch with the corresponding target sequence. In some embodiments, the oligonucleotide comprises a targeting sequence or region of complementarity having 2 mismatches with the corresponding target sequence. In some embodiments, the oligonucleotide comprises a targeting sequence or region of complementarity having 3 mismatches with the corresponding target sequence. In some embodiments, the oligonucleotide comprises a targeting sequence or region of complementarity having 4 mismatches with the corresponding target sequence. In some embodiments, the oligonucleotide comprises a targeting sequence or region of complementarity having 5 mismatches with the corresponding target sequence. In some embodiments, the oligonucleotide comprises a targeting sequence or region of complementarity more than one mismatch (e.g., 2, 3, 4, 5 or more mismatches) with the corresponding target sequence, wherein at least 2 (e.g., all) of the mismatches are positioned consecutively (e.g., 2, 3, 4, 5 or more mismatches in a row), or where in the mismatches are interspersed throughout the targeting sequence or region of complementarity. In some embodiments, the oligonucleotide comprises a targeting sequence or a region of complementary that is complementary to a contiguous sequence of nucleotides of SEQ ID NO: 140, wherein the targeting sequence or region of complementarity may have up to about 1, up to about 2, up to about 3, up to about 4, up to about 5, etc. mismatches with the corresponding STAT3 target sequence. In some embodiments, the oligonucleotide comprises a targeting sequence or a region of complementary that is complementary to a contiguous sequence of nucleotides of SEQ ID NO: 140, wherein the targeting sequence or region of complementarity may have no more than 1, no more than 2, no more than 3, no more than 4, or no more than 5 mismatches with the corresponding STAT3 target sequence.

Types of Oligonucleotides

A variety of oligonucleotide types and/or structures are useful for targeting a target sequence in the methods herein including, but not limited to, RNAi oligonucleotides, antisense oligonucleotides, miRNAs, etc. Any of the oligonucleotide types described herein or elsewhere are contemplated for use as a framework to incorporate a targeting sequence herein.

In some embodiments, the oligonucleotides herein inhibit expression of a target sequence by engaging with RNA interference (RNAi) pathways upstream or downstream of Dicer involvement. For example, RNAi oligonucleotides have been developed with each strand having sizes of about 19-25 nucleotides with at least one 3' overhang of 1 to 5 nucleotides (see, e.g., U.S. Pat. No. 8,372,968). Longer oligonucleotides also have been developed that are processed by Dicer to generate active RNAi products (see, e.g., U.S. Pat. No. 8,883,996). Further work produced extended dsRNAs where at least one end of at least one strand is extended beyond a duplex targeting region, including structures where one of the strands includes a thermodynamically-stabilizing tetraloop structure (see, e.g., U.S. Pat. Nos. 8,513,207 and 8,927,705, as well as Intl. Patent Application Publication No. WO 2010/033225). Such structures may include ss extensions (on one or both sides of the molecule) as well as ds extensions.

In some embodiments, the oligonucleotides herein engage with the RNAi pathway downstream of the involvement of Dicer (e.g., Dicer cleavage). In some embodiments, the oligonucleotides described herein are Dicer substrates. In some embodiments, upon endogenous Dicer processing, double-stranded nucleic acids of 19-23 nucleotide sin length capable of reducing target mRNA expression are produced. In some embodiments, the oligonucleotide has an overhang (e.g., of 1, 2, or 3 nucleotides in length) in the 3' end of the sense strand. In some embodiments, the oligonucleotide (e.g., siRNA) comprises a 21-nucleotide guide strand that is antisense to a target RNA and a complementary passenger strand, in which both strands anneal to form a 19-bp duplex and 2 nucleotide overhangs at either or both 3' ends. Longer oligonucleotide designs also are available including oligonucleotides having a guide strand of 23 nucleotides and a passenger strand of 21 nucleotides, where there is a blunt end on the right side of the molecule (3' end of passenger strand/5' end of guide strand) and a two nucleotide 3'-guide strand overhang on the left side of the molecule (5' end of the passenger strand/3' end of the guide strand). In such molecules, there is a 21 bp duplex region. See, e.g., U.S. Pat. Nos. 9,012,138; 9,012,621 and 9,193,753.

In some embodiments, the oligonucleotides herein comprise sense and antisense strands that are both in the range of about 17 to 26 (e.g., 17 to 26, 20 to 25 or 21-23) nucleotides in length. In some embodiments, the oligonucleotides herein comprise sense and antisense strands that are both in the range of about 17 to 36 (e.g., 17 to 36, 20 to 25 or 21-23) nucleotides in length. In some embodiments, the oligonucleotides described herein comprise an antisense strand of 19-30 nucleotides in length and a sense strand of 19-50 nucleotides in length, wherein the antisense and sense strands are separate strands which form an asymmetric duplex region having an overhand of 1-4 nucleotides at the 3' terminus of the antisense strand. In some embodiments, an oligonucleotide herein comprises a sense and antisense strand that are both in the range of about 19-22 nucleotides in length. In some embodiments, the sense and antisense strands are of equal length. In some embodiments, an oligonucleotide comprises sense and antisense strands, such that there is a 3'-overhang on either the sense strand or the antisense strand, or both the sense and antisense strand. In some embodiments, for oligonucleotides that have sense and antisense strands that are both in the range of about 21-23 nucleotides in length, a 3' overhang on the sense, antisense, or both sense and antisense strands is 1 or 2 nucleotides in length. In some embodiments, the oligonucleotide has a guide strand of 22 nucleotides and a passenger strand of 20 nucleotides, where there is a blunt end on the right side of the molecule (3' end of passenger strand/5' end of guide strand) and a 2 nucleotide 3'-guide strand overhang on the left side of the molecule (5' end of the passenger strand/3' end of the guide strand). In such molecules, there is a 20 bp duplex region.

Other oligonucleotide designs for use with the compositions and methods herein include: 16-mer siRNAs (see, e.g., NUCLEIC ACIDS IN CHEMISTRY AND BIOLOGY. Blackburn (ed.), Royal Society of Chemistry, 2006), shRNAs (e.g., having 19 bp or shorter stems; (see, e.g., Moore et al., (2010) Methods Mol. Biol. 629:141-58), blunt siRNAs (e.g., of 19 bps in length; see, e.g., Kraynack and Baker (2006) *RNA* 12:163-76), asymmetrical siRNAs (aiRNA; see, e.g., Sun et al., (2008) Nat. Biotechnol. 26:1379-82), asymmetric shorter-duplex siRNA (see, e.g., Chang et al., (2009) MOL. THER. 17:725-32), fork siRNAs (see, e.g., Hohjoh (2004) FEBS LETT. 557:193-98), ss siRNAs (Elsner (2012) NAT. BIOTECHNOL. 30:1063), dumbbell-shaped circular siRNAs (see, e.g., Abe et al., (2007) J. AM. CHEM. SOC. 129: 15108-09), and small internally segmented interfering RNA (siRNA; see, e.g., Bramsen et al., (2007) NUCLEIC ACIDS RES. 35:5886-97). Further non-limiting examples of an oligonucleotide structures that may be used in some embodiments to reduce or inhibit the expression of STAT3 are microRNA (miRNA), short hairpin RNA (shRNA) and short siRNA (see, e.g., Hamilton et al., (2002) EMBO J. 21:4671-79; see also, US Patent Application Publication No. 2009/0099115).

Still, in some embodiments, an oligonucleotide for reducing or inhibiting expression of a target sequence herein is ss. Such structures may include but are not limited to ss RNAi molecules. Recent efforts have demonstrated the activity of ss RNAi molecules (see, e.g., Matsui et al., (2016) MOL. THER. 24:946-55). However, in some embodiments, oligonucleotides herein are antisense oligonucleotides (ASOs). An antisense oligonucleotide is a ss oligonucleotide that has a nucleobase sequence which, when written in the 5' to 3' direction, comprises the reverse complement of a targeted segment of a particular nucleic acid and is suitably modified (e.g., as a gapmer) to induce RNaseH-mediated cleavage of its target RNA in cells or (e.g., as a mixmer) to inhibit translation of the target mRNA in cells. ASOs for use herein may be modified in any suitable manner known in the art including, for example, as shown in U.S. Pat. No. 9,567,587 (including, e.g., length, sugar moieties of the nucleobase (pyrimidine, purine), and alterations of the heterocyclic portion of the nucleobase). Further, ASOs have been used for decades to reduce expression of specific target genes (see, e.g., Bennett et al., (2017) ANNU. REV. PHARMACOL. 57:81-105).

In some embodiments, the antisense oligonucleotide shares a region of complementarity with a target mRNA. In some embodiments, the antisense oligonucleotide is 15-50 nucleotides in length. In some embodiments, the antisense oligonucleotide is 15-25 nucleotides in length. In some embodiments, the antisense oligonucleotide is 22 nucleotides in length. In some embodiments, the antisense oligonucleotide is at least 15 contiguous nucleotides in length. In some embodiments, the antisense oligonucleotide is at least 19 contiguous nucleotides in length. In some embodiments, the antisense oligonucleotide is at least 20 contiguous nucleotides in length. In some embodiments, the antisense oligonucleotide differs by 1, 2, or 3 nucleotides from the target sequence.

Double-Stranded Oligonucleotides

In some embodiments, the disclosure provides double-stranded dsRNAs for targeting and inhibiting expression of a target sequence (e.g., via the RNAi pathway) comprising a sense strand (also referred to herein as a passenger strand) and an antisense strand (also referred to herein as a guide strand). In some embodiments, the sense strand and antisense strand are separate strands and are not covalently linked. In some embodiments, the sense strand and antisense strand are covalently linked. In some embodiments, the sense strand and antisense strand form a duplex region, wherein the sense strand and antisense strand, or a portion thereof, binds with one another in a complementary fashion (e.g., by Watson-Crick base pairing).

In some embodiments, the sense strand has a first region (R1) and a second region (R2), wherein R2 comprises a first subregion (S1), a loop (L), such as a tetraloop (tetraL) or triloop (triL), and a second subregion (S2), wherein L, tetraL, or triL is located between S1 and S2, and wherein S1 and S2 form a second duplex (D2). D2 may have various length. In some embodiments, D2 is about 1-6 bp in length. In some embodiments, D2 is 2-6, 3-6, 4-6, 5-6, 1-5, 2-5, 3-5 or 4-5 bp in length. In some embodiments, D2 is 1, 2, 3, 4, 5 or 6 bp in length. In some embodiments, D2 is 6 bp in length.

In some embodiments, R1 of the sense strand and the antisense strand form a first duplex (D1). In some embodiments, D1 is at least about 15 (e.g., at least 15, at least 16, at least 17, at least 18, at least 19, at least 20 or at least 21) nucleotides in length. In some embodiments, D1 is in the range of about 12 to 30 nucleotides in length (e.g., 12 to 30, 12 to 27, 15 to 22, 18 to 22, 18 to 25, 18 to 27, 18 to 30 or 21 to 30 nucleotides in length). In some embodiments, D1 is at least 12 nucleotides in length (e.g., at least 12, at least 15, at least 20, at least 25, or at least 30 nucleotides in length). In some embodiments, D1 is 12, 13, 14, 15, 16, 17, 18, 19, 20, 21, 22, 23, 24, 25, 26, 27, 28, 29 or 30 nucleotides in length. In some embodiments, D1 is 20 nucleotides in length. In some embodiments, D1 comprising sense strand and antisense strand does not span the entire length of the sense strand and/or antisense strand. In some embodiments, D1 comprising the sense strand and antisense strand spans the entire length of either the sense strand or antisense strand or both. In certain embodiments, D1 comprising the sense strand and antisense strand spans the entire length of both the sense strand and the antisense strand.

It should be appreciated that, in some embodiments, sequences presented in the Sequence Listing may be referred to in describing the structure of an oligonucleotide or other nucleic acid. In such embodiments, the actual oligonucleotide or other nucleic acid may have one or more alternative nucleotides (e.g., an RNA counterpart of a DNA nucleotide or a DNA counterpart of an RNA nucleotide) and/or one or more modified nucleotides and/or one or more modified internucleotide linkages and/or one or more other modification when compared with the specified sequence while retaining essentially same or similar complementary properties as the specified sequence.

In some embodiments, a double-stranded RNA (dsRNA) herein comprises a 25-nucleotide sense strand and a 27-nucleotide antisense strand that when acted upon by a Dicer enzyme result in an antisense strand that is incorporated into the mature RISC. In some embodiments, the sense strand of the dsRNA is longer than 27 nucleotides (e.g., 28, 29, 30, 31, 32, 33, 34, 35, 36, 37, 38, 39 or 40 nucleotides). In some embodiments, the sense strand of the dsRNA is longer than 27 nucleotides (e.g., 28, 29, 30, 31, 32, 33, 34, 35, 36, 37, 38, 39, 40, 41, 42, 43, 44, 45, 46, 47, 48, 49, or 50 nucleotides). In some embodiments, the sense strand of the dsRNA is longer than 25 nucleotides (e.g., 26, 27, 28, 29 or 30 nucleotides).

In some embodiments, oligonucleotides herein have one 5' end that is thermodynamically less stable when compared to the other 5' end. In some embodiments, an asymmetry oligonucleotide is provided that includes a blunt end at the 3' end of a sense strand and a 3'-overhang at the 3' end of an antisense strand. In some embodiments, the 3'-overhang on the antisense strand is about 1-8 nucleotides in length (e.g., 1, 2, 3, 4, 5, 6, 7 or 8 nucleotides in length). Typically, an oligonucleotide for RNAi has a two-nucleotide overhang on the 3' end of the antisense (guide) strand. However, other overhangs are possible. In some embodiments, an overhang is a 3'-overhang comprising a length of between 1 and 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5 or 6 nucleotides. However, in some embodiments, the overhang is a 5'-overhang comprising a length of between 1 and 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5 or 6 nucleotides.

In some embodiments, two terminal nucleotides on the 3' end of an antisense strand are modified. In some embodiments, the two terminal nucleotides on the 3' end of the antisense strand are complementary with the target mRNA. In some embodiments, the two terminal nucleotides on the 3' end of the antisense strand are not complementary with the target mRNA. In some embodiments, the two terminal nucleotides on the 3' end of the antisense strand of an oligonucleotide herein comprise an unpaired GG. In some embodiments, the two (2) terminal nucleotides on the 3' end of an antisense strand of an oligonucleotide herein are not complementary to the target mRNA. In some embodiments, two terminal nucleotides on each 3' end of an oligonucleotide in the nicked tetraloop structure are GG. In some embodiments, one or both of the two (2) terminal GG nucleotides on each 3' end of an oligonucleotide herein is not complementary with the target mRNA. Typically, one or both two terminal GG nucleotides on each 3' end of an oligonucleotide is not complementary with the target.

In some embodiments, there is one or more (e.g., 1, 2, 3, 4 or 5) mismatch between a sense and antisense strand. If there is more than one mismatch between a sense and antisense strand, they may be positioned consecutively (e.g., 2, 3 or more in a row), or interspersed throughout the region of complementarity. In some embodiments, the 3' end of the sense strand contains one or more mismatches. In one embodiment, two mismatches are incorporated at the 3' end of the sense strand. In some embodiments, base mismatches, or destabilization of segments at the 3' end of the sense strand of the oligonucleotide improved the potency of synthetic duplexes in RNAi, possibly through facilitating processing by Dicer.

a. Antisense Strands

In some embodiments, a dsRNA comprises an antisense strand of up to about 40 nucleotides in length (e.g., up to 40, up to 35, up to 30, up to 27, up to 25, up to 21, up to 19, up to 17 or up to 12 nucleotides in length). In some embodiments, an oligonucleotide herein (e.g., an RNAi oligonucleotide) comprises an antisense strand of up to about 50 nucleotides in length (e.g., up to 50, up to 40, up to 35, up to 30, up to 27, up to 25, up to 21, up to 19, up to 17 or up to 12 nucleotides in length). In some embodiments, an oligonucleotide may have an antisense strand of at least about 12 nucleotides in length (e.g., at least 12, at least 15, at least 19, at least 21, at least 22, at least 25, at least 27, at least 30, at least 35 or at least 38 nucleotides in length). In some embodiments, an oligonucleotide may have an antisense strand in a range of about 12 to about 40 (e.g., 12 to 40, 12 to 36, 12 to 32, 12 to 28, 15 to 40, 15 to 36, 15 to 32, 15 to 28, 17 to 22, 17 to 25, 19 to 27, 19 to 30, 20 to 40, 22 to 40, 25 to 40 or 32 to 40) nucleotides in length. In some embodiments, an oligonucleotide comprises antisense strand of 15 to 30 nucleotides in length. In some embodiments, an oligonucleotide may have an antisense strand of 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length.

In some embodiments, an antisense strand of an oligonucleotide may be referred to as a "guide strand." For example, if an antisense strand can engage with RNA-induced silencing complex (RISC) and bind to an Argonaute protein such as Ago2, or engage with or bind to one or more similar factors, and direct silencing of a target gene, it may be referred to as a guide strand. In some embodiments, a sense strand complementary to a guide strand may be referred to as a "passenger strand."

In some embodiments, an oligonucleotide disclosed herein for targeting STAT3 comprises an antisense strand comprising or consisting of a sequence as set forth in SEQ ID NO: 333. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22 or at least 23) contiguous nucleotides of a sequence as set forth in SEQ ID NO: 333. In some embodiments, an oligonucleotide disclosed herein (e.g., an RNAi oligonucleotide) for targeting STAT3 comprises an antisense strand comprising or consisting of a sequence as set forth in SEQ ID NO: 716. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22 or at least 23) contiguous nucleotides of a sequence as set forth in SEQ ID NO: 716. In some embodiments, an oligonucleotide disclosed herein for targeting STAT3 comprises an antisense strand comprising or consisting of a sequence as set forth in SEQ ID NO: 965. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22 or at least 23) contiguous nucleotides of a sequence as set forth in SEQ ID NO: 965. In some embodiments, an oligonucleotide disclosed herein for targeting STAT3 comprises an antisense strand comprising or consisting of a sequence as set forth in SEQ ID NO: 333. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22 or at least 23) contiguous nucleotides of a sequence as set forth in SEQ ID NO: 333.

b. Sense Strands

In some embodiments, an oligonucleotide disclosed herein (e.g., and RNAi oligonucleotide) for targeting STAT3 mRNA and inhibiting STAT3 expression comprises a sense strand sequence as set forth in SEQ ID NO: 140. In some embodiments, an oligonucleotide herein has a sense strand that comprise at least about 12 (e.g., at least 13, at least 14, at least 15, at least 16, at least 17, at least 18, at least 19, at least 20, at least 21, at least 22 or at least 23) contiguous nucleotides of a sequence as set forth in SEQ ID NOs: 140. In some embodiments, an oligonucleotide disclosed herein (e.g., an RNAi oligonucleotide) for targeting STAT3 mRNA and inhibiting STAT3 expression comprises a sense strand sequence a set forth in SEQ ID NO: 524. In some embodiments, an oligonucleotide herein has a sense strand that comprise at least about 12 (e.g., at least 13, at least 14, at least 15, at least 16, at least 17, at least 18, at least 19, at least 20, at least 21, at least 22 or at least 23) contiguous nucleotides of a sequence as set forth in SEQ ID NO: 524. In some embodiments, an oligonucleotide disclosed herein for targeting STAT3 mRNA and inhibiting STAT3 expression comprises a sense strand sequence as set forth in SEQ ID NO: 875. In some embodiments, an oligonucleotide herein has a sense strand comprised of least about 12 (e.g., at least 13, at least 14, at least 15, at least 16, at least 17, at least 18, at least 19, at least 20, at least 21, at least 22 or at least 23) contiguous nucleotides of a sequence as set forth in SEQ ID NO:875.

In some embodiments, an oligonucleotide comprises a sense strand (or passenger strand) of up to about 40 nucleotides in length (e.g., up to 40, up to 36, up to 30, up to 27, up to 25, up to 21, up to 19, up to 17 or up to 12 nucleotides in length). In some embodiments, an oligonucleotide may have a sense strand of at least about 12 nucleotides in length (e.g., at least 12, at least 15, at least 19, at least 21, at least 25, at least 27, at least 30, at least 36 or at least 38 nucleotides in length). In some embodiments, an oligonucleotide may have a sense strand in a range of about 12 to about 40 (e.g., 12 to 40, 12 to 36, 12 to 32, 12 to 28, 15 to 40, 15 to 36, 15 to 32, 15 to 28, 17 to 21, 17 to 25, 19 to 27, 19 to 30, 20 to 40, 22 to 40, 25 to 40 or 32 to 40) nucleotides in length. In some embodiments, an oligonucleotide herein comprises a sense strand of 15 to 50 nucleotides in length. In some embodiments, an oligonucleotide herein comprises a sense strand of 18 to 36 nucleotides in length. In some embodiments, an oligonucleotide may have a sense strand of 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length. In some embodiments, an oligonucleotide comprises a sense strand of 12, 13, 14, 15, 16, 17, 18, 19, 20, 21, 22, 23, 24, 25, 26, 27, 28, 29, 30, 31, 32, 33, 34, 35, 36, 37, 38, 39, 40,41, 42, 43, 44, 45, 46, 47, 48, 49, or 50 nucleotides in length. In some embodiments, an oligonucleotide herein comprises a sense strand of 36 nucleotides in length.

In some embodiments, an oligonucleotide provided herein (e.g., an RNAi oligonucleotide) comprises a sense strand comprising a stem-loop structure at the 3' end of the sense strand. In some embodiments, the stem-loop is formed by intrastrand base pairing. In some embodiments, a sense strand comprises a stem-loop structure at its 5' end. In some embodiments, the stem of the stem-loop comprises a duplex of 2, 3, 4, 5, 6, 7, 8, 9, 10, 11, 12, 13 or 14 nucleotides in length. In some embodiments, the stem of the stem-loop comprises a duplex of 2 nucleotides in length. In some embodiments, the stem of the stem-loop comprises a duplex of 3 nucleotides in length. In some embodiments, the stem of the stem-loop comprises a duplex of 4 nucleotides in length. In some embodiments, the stem of the stem-loop comprises a duplex of 5 nucleotides in length. In some embodiments, the stem of the stem-loop comprises a duplex of 6 nucleotides in length. In some embodiments, the stem of the stem-loop comprises a duplex of 7 nucleotides in length. In some embodiments, the stem of the stem-loop comprises a duplex of 8 nucleotides in length. In some embodiments, the stem of the stem-loop comprises a duplex of 9 nucleotides in length. In some embodiments, the stem of the stem-loop comprises a duplex of 10 nucleotides in length. In some embodiments, the stem of the stem-loop comprises a duplex of 11 nucleotides in length. In some embodiments, the stem of the stem-loop comprises a duplex of 12 nucleotides in length. In some embodiments, the stem of the stem-loop comprises a duplex of 13 nucleotides in length. In some embodiments, the stem of the stem-loop comprises a duplex of 14 nucleotides in length.

In some embodiments, a stem-loop provides the oligonucleotide protection against degradation (e.g., enzymatic degradation), facilitates or improves targeting and/or delivery to a target cell, tissue, or organ (e.g., the liver), or both. For example, in some embodiments, the loop of a stem-loop is comprised of nucleotides comprising one or more modifications that facilitate, improve, or increase targeting to a target, inhibition of target gene expression, and/or delivery, uptake, and/or penetrance into a target cell, tissue, or organ (e.g., the liver), or a combination thereof. In some embodiments, the stem-loop itself or modification(s) to the stem-loop do not affect or do not substantially affect the inherent gene expression inhibition activity of the oligonucleotide, but facilitates, improves, or increases stability (e.g., provides protection against degradation) and/or delivery, uptake, and/or penetrance of the oligonucleotide to a target cell, tissue, or organ. In certain embodiments, an oligonucleotide herein comprises a sense strand comprising (e.g., at its 3' end) a stem-loop set forth as: S1-L-S2, in which S1 is complementary to S2, and in which L forms a single-stranded loop of linked nucleotides between S1 and S2 of up to about 10 nucleotides in length (e.g., 3, 4, 5, 6, 7, 8, 9 or 10 nucleotides in length). In some embodiments, the loop (L) is 3 nucleotides in length (referred to herein as "triloop". In some embodiments, the loop (L) is 4 nucleotides in length (referred to herein as "tetraloop"). In some embodiments, the loop (L) is 5 nucleotides in length. In some embodiments, the loop (L) is 6 nucleotides in length. In some embodiments, the loop (L) is 7 nucleotides in length. In some embodiments, the loop (L) is 8 nucleotides in length. In some embodiments, the loop (L) is 9 nucleotides in length. In some embodiments, the loop (L) is 10 nucleotides in length.

In some embodiments, an oligonucleotide provided herein (e.g., an RNAi oligonucleotide) comprises a targeting sequence or a region of complementary that is complementary to a contiguous sequence of nucleotides of SEQ ID NO: 140, and the oligonucleotide comprises a sense strand comprising (e.g., at its 3' end) a stem-loop set forth as: S1-L-S2, in which S1 is complementary to S2, and in which L forms a single-stranded loop between S1 and S2 of up to about 10 nucleotides in length (e.g., 3, 4, 5, 6, 7, 8, 9 or 10 nucleotides in length). In some embodiments, the oligonucleotide comprises a targeting sequence or a region of complementary that is complementary to a contiguous sequence of nucleotides of SEQ ID NOs: 140, and the oligonucleotide comprises a sense strand comprising (e.g., at its 3' end) a stem-loop set forth as: S1-L-S2, in which S1 is complementary to S2, and in which L forms a single-stranded loop between S1 and S2 of 4 nucleotides in length.

In some embodiments, the tetraloop comprises the sequence 5'-GAAA-3'. In some embodiments, the stem loop comprises the sequence 5'-GCAGCCGAAAGGCUGC-3' (SEQ ID NO: 86).

In some embodiments, a sense strand comprises a stem-loop structure at its 3' end. In some embodiments, a sense strand comprises a stem-loop structure at its 5' end. In some embodiments, a stem is a duplex of 2, 3, 4, 5, 6, 7, 8, 9, 10, 11, 12, 13 or 14 bp in length. In some embodiments, a stem-loop provides the molecule protection against degradation (e.g., enzymatic degradation) and facilitates targeting characteristics for delivery to a target cell. For example, in some embodiments, a loop provides added nucleotides on which modification can be made without substantially affecting the gene expression inhibition activity of an oligonucleotide. In certain embodiments, an oligonucleotide is herein in which the sense strand comprises (e.g., at its 3' end) a stem-loop set forth as: S1-L-S2, in which S1 is complementary to S2, and in which L forms a loop between S1 and S2 of up to about 10 nucleotides in length (e.g., 3, 4, 5, 6, 7, 8, 9 or 10 nucleotides in length). FIG. 1 depicts non-limiting examples of such an oligonucleotide.

In some embodiments, a loop (L) of a stem-loop having the structure S1-L-S2 as described herein is a triloop. In some embodiments, the triloop comprises ribonucleotides, deoxyribonucleotides, modified nucleotides, ligands (e.g., delivery ligands), and combinations thereof.

In some embodiments, a loop of a stem-loop is a tetraloop (e.g., within a nicked tetraloop structure). A tetraloop may contain ribonucleotides, deoxyribonucleotides, modified nucleotides and combinations thereof. Typically, a tetraloop has 4 to 5 nucleotides.

Duplex Length

In some embodiments, a duplex formed between a sense and antisense strand is at least 12 (e.g., at least 15, at least 16, at least 17, at least 18, at least 19, at least 20, or at least 21) nucleotides in length. In some embodiments, a duplex formed between a sense and antisense strand is in the range of 12-30 nucleotides in length (e.g., 12 to 30, 12 to 27, 12 to 22, 15 to 25, 18 to 30, 18 to 22, 18 to 25, 18 to 27, 18 to 30, 19 to 30 or 21 to 30 nucleotides in length). In some embodiments, a duplex formed between a sense and antisense strand is 12, 13, 14, 15, 16, 17, 18, 19, 29, 21, 22, 23, 24, 25, 26, 27, 28, 29 or 30 nucleotides in length. In some embodiments, a duplex formed between a sense and antisense strand is 12 nucleotides in length. In some embodiments, a duplex formed between a sense and antisense strand is 13 nucleotides in length. In some embodiments, a duplex formed between a sense and antisense strand is 14 nucleotides in length. In some embodiments, a duplex formed between a sense and antisense strand is 15 nucleotides in length. In some embodiments, a duplex formed between a sense and antisense strand is 16 nucleotides in length. In some embodiments, a duplex formed between a sense and antisense strand is 17 nucleotides in length. In some embodiments, a duplex formed between a sense and antisense strand is 18 nucleotides in length. In some embodiments, a duplex formed between a sense and antisense strand is 19 nucleotides in length. In some embodiments, a duplex formed between a sense and antisense strand is 20 nucleotides in length. In some embodiments, a duplex formed between a sense and antisense strand is 21 nucleotides in length. In some embodiments, a duplex formed between a sense and antisense strand is 22 nucleotides in length. In some embodiments, a duplex formed between a sense and antisense strand is 23 nucleotides in length. In some embodiments, a duplex formed between a sense and antisense strand is 24 nucleotides in length. In some embodiments, a duplex formed between a sense and antisense strand is 25 nucleotides in length. In some embodiments, a duplex formed between a sense and antisense strand is 26 nucleotides in length. In some embodiments, a duplex formed between a sense and antisense strand is 27 nucleotides in length. In some embodiments, a duplex formed between a sense and antisense strand is 28 nucleotides in length. In some embodiments, a duplex formed between a sense and antisense strand is 29 nucleotides in length. In some embodiments, a duplex formed between a sense and antisense strand is 30 nucleotides in length. In some embodiments, a duplex formed between a sense and antisense strand does not span the entire length of the sense strand and/or antisense strand. In some embodiments, a duplex between a sense and antisense strand spans the entire length of either the sense or antisense strands. In some embodiments, a duplex between a sense and antisense strand spans the entire length of both the sense strand and the antisense strand.

In some embodiments, a duplex between a sense and antisense strand spans the entire length of both the sense strand and the antisense strand. In some embodiments, the sense and antisense strands of an oligonucleotide comprise nucleotides sequences selected from the group consisting of:

(a) SEQ ID NOs: 875 and 965, respectively, wherein a duplex formed between a sense and antisense strand is in the range of 12-30 nucleotides in length (e.g., 12 to 30, 12 to 27, 12 to 22, 15 to 25, 18 to 30, 18 to 22, 18 to 25, 18 to 27, 18 to 30, 19 to 30 or 21 to 30 nucleotides in length).

Oligonucleotide Termini

In some embodiments, an oligonucleotide disclosed herein (e.g., an RNAi oligonucleotide) comprises a sense strand and an antisense strand, wherein the termini of either or both strands comprise a blunt end. In some embodiments, an oligonucleotide herein comprises sense and antisense strands that are separate strands which form an asymmetric duplex region having an overhang at the 3' terminus of the antisense strand. In some embodiments, an oligonucleotide herein comprises a sense strand and an antisense strand, wherein the termini of either or both strands comprise an overhang comprising one or more nucleotides. In some embodiments, the one or more nucleotides comprising the overhang are unpaired nucleotides. In some embodiments, an oligonucleotide herein comprises a sense strand and an antisense strand, wherein the 3' termini of the sense strand and the 5' termini of the antisense strand comprise a blunt end. In some embodiments, an oligonucleotide herein comprises a sense strand and an antisense strand, wherein the 5' termini of the sense strand and the 3' termini of the antisense strand comprise a blunt end.

In some embodiments, an oligonucleotide herein comprises a sense strand and an antisense strand, wherein the 3' terminus of either or both strands comprise a 3'-overhang comprising one or more nucleotides. In some embodiments, an oligonucleotide herein comprises a sense strand and an antisense strand, wherein the sense strand comprises a 3'-overhang comprising one or more nucleotides. In some embodiments, an oligonucleotide herein comprises a sense strand and an antisense strand, wherein the antisense strand comprises a 3'-overhang comprising one or more nucleotides. In some embodiments, an oligonucleotide herein comprises a sense strand and an antisense strand, wherein both the sense strand and the antisense strand comprises a 3'-overhang comprising one or more nucleotides.

In some embodiments, the 3'-overhang is about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length). In some embodiments, the 3' overhang is about one (1) to nineteen (19), one (1) to eighteen (18), one (1) to seventeen (17), one (1) to sixteen (16), one (1) to fifteen (15), one (1) to fourteen (14), one (1) to thirteen (13), one (1) to twelve (12), one (1) to eleven (11), one (1) to ten (10), one (1) to nine (9), one (1) to eight (8), one (1) to seven (7), one (1) to six (6), one (1) to five (5), one (1) to four (4), one (1) to three (3), or about one (1) to two (2) nucleotides in length. In some embodiments, the 3'-overhang is (1) nucleotide in length. In some embodiments, the 3'-overhang is two (2) nucleotides in length. In some embodiments, the 3'-overhang is three (3) nucleotides in length. In some embodiments, the 3'-overhang is four (4) nucleotides in length. In some embodiments, the 3'-overhang is five (5) nucleotides in length. In some embodiments, the 3'-overhang is six (6) nucleotides in length. In some embodiments, the 3'-overhang is seven (7) nucleotides in length. In some embodiments, the 3'-overhang is eight (8) nucleotides in length. In some embodiments, the 3'-overhang is nine (9) nucleotides in length. In some embodiments, the 3'-overhang is ten (10) nucleotides in length. In some embodiments, the 3'-overhang is eleven (11) nucleotides in length. In some embodiments, the 3'-overhang is twelve (12) nucleotides in length. In some embodiments, the 3'-overhang is thirteen (13) nucleotides in length. In some embodiments, the 3'-overhang is fourteen (14) nucleotides in length. In some embodiments, the 3'-overhang is fifteen (15) nucleotides in length. In some embodiments, the 3'-overhang is sixteen (16) nucleotides in length. In some embodiments, the 3'-overhang is seventeen (17) nucleotides in length. In some embodiments, the 3'-overhang is eighteen (18) nucleotides in length. In some embodiments, the 3'-overhang is nineteen (19) nucleotides in length. In some embodiments, the 3'-overhang is twenty (20) nucleotides in length.

In some embodiments, an oligonucleotide herein comprises a sense strand and an antisense strand, wherein the 5' terminus of either or both strands comprise a 5'-overhang comprising one or more nucleotides. In some embodiments, an oligonucleotide herein comprises a sense strand and an antisense strand, wherein the sense strand comprises a 5'-overhang comprising one or more nucleotides. In some embodiments, an oligonucleotide herein comprises a sense strand and an antisense strand, wherein the antisense strand comprises a 5'-overhang comprising one or more nucleotides. In some embodiments, an oligonucleotide herein comprises a sense strand and an antisense strand, wherein both the sense strand and the antisense strand comprises a 5'-overhang comprising one or more nucleotides.

In some embodiments, the 5'-overhang is about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length). In some embodiments, the 5' overhang is about one (1) to nineteen (19), one (1) to eighteen (18), one (1) to seventeen (17), one (1) to sixteen (16), one (1) to fifteen (15), one (1) to fourteen (14), one (1) to thirteen (13), one (1) to twelve (12), one (1) to eleven (11), one (1) to ten (10), one (1) to nine (9), one (1) to eight (8), one (1) to seven (7), one (1) to six (6), one (1) to five (5), one (1) to four (4), one (1) to three (3), or about one (1) to two (2) nucleotides in length. In some embodiments, the 5'-overhang is (1) nucleotide in length. In some embodiments, the 5'-overhang is two (2) nucleotides in length. In some embodiments, the 5'-overhang is three (3) nucleotides in length. In some embodiments, the 5'-overhang is four (4) nucleotides in length. In some embodiments, the 5'-overhang is five (5) nucleotides in length. In some embodiments, the 5'-overhang is six (6) nucleotides in length. In some embodiments, the 5'-overhang is seven (7) nucleotides in length. In some embodiments, the 5'-overhang is eight (8) nucleotides in length. In some embodiments, the 5'-overhang is nine (9) nucleotides in length. In some embodiments, the 5'-overhang is ten (10) nucleotides in length. In some embodiments, the 5'-overhang is eleven (11) nucleotides in length. In some embodiments, the 5'-overhang is twelve (12) nucleotides in length. In some embodiments, the 5'-overhang is thirteen (13) nucleotides in length. In some embodiments, the 5'-overhang is fourteen (14) nucleotides in length. In some embodiments, the 5'-overhang is fifteen (15) nucleotides in length. In some embodiments, the 5'-overhang is sixteen (16) nucleotides in length. In some embodiments, the 5'-overhang is seventeen (17) nucleotides in length. In some embodiments, the 5'-overhang is eighteen (18) nucleotides in length. In some embodiments, the 5'-overhang is nineteen (19) nucleotides in length. In some embodiments, the 5'-overhang is twenty (20) nucleotides in length.

In some embodiments, one or more (e.g., 2, 3, 4, 5, or more) nucleotides comprising the 3' terminus or 5' terminus of a sense and/or antisense strand are modified. For example, in some embodiments, one or two terminal nucleotides of the 3' terminus of the antisense strand are modified. In some embodiments, the last nucleotide at the 3' terminus of an antisense strand is modified, such that it comprises 2' modification, or it comprises, a 2'-O-methoxyethyl. In some embodiments, the last one or two terminal nucleotides at the 3' terminus of an antisense strand are complementary with the target. In some embodiments, the last one or two nucleotides at the 3' terminus of the antisense strand are not complementary with the target.

In some embodiments, an oligonucleotide disclosed herein (e.g., an RNAi oligonucleotide) comprises a sense strand and an antisense strand, wherein the 3' terminus of the sense strand comprises a step-loop described herein and the 3' terminus of the antisense strand comprises a 3'-overhang described herein. In some embodiments, an oligonucleotide herein (e.g., an RNAi oligonucleotide) comprises a sense strand and an antisense strand that form a nicked tetraloop structure described herein, wherein the 3' terminus of the sense strand comprises a stem-loop, wherein the loop is a tetraloop described herein, and wherein the 3' terminus of the antisense strand comprises a 3'-overhang described herein. In some embodiments, the 3'-overhang is two (2) nucleotides in length. In some embodiments, the two (2) nucleotides comprising the 3'-overhang both comprise guanine (G) nucleobases. Typically, one or both of the nucleotides comprising the 3'-overhang of the antisense strand are not complementary with the target mRNA.

Oligonucleotide Modifications a. Sugar Modifications

In some embodiments, a modified sugar (also referred herein to a sugar analog) includes a modified deoxyribose or ribose moiety in which, for example, one or more modifications occur at the 2', 3', 4' and/or 5' carbon position of the sugar. In some embodiments, a modified sugar may also include non-natural alternative carbon structures such as those present in locked nucleic acids ("LNA"; see, e.g., Koshkin et al., (1998) Tetrahedon 54:3607-3630), unlocked nucleic acids ("UNA"; see, e.g., Snead et al., (2013) Mol. Ther-Nucl. Acids 2:e103) and bridged nucleic acids ("BNA"; see, e.g., Imanishi and Obika (2002) Chem Commun. (Camb) 21:1653-1659).

In some embodiments, a nucleotide modification in a sugar comprises a 2'-modification. In some embodiments, a 2'-modification may be 2'-O-propargyl, 2'-O-propylamin, 2'-amino, 2'-ethyl, 2'-fluoro (2'-F), 2'-aminoethyl (EA), 2'-O-methyl(2'-OMe), 2'-O-methoxyethyl(2'-MOE), 2'-O-[2-(methylamino)-2-oxoethyl] (2'-O-NMA) or 2'-deoxy-2'-fluoro-β-d-arabinonucleic acid (2'-FANA). In some embodiments, the modification is 2'-F, 2'-OMe or 2'-MOE. In some embodiments, a modification in a sugar comprises a modification of the sugar ring, which may comprise modification of one or more carbons of the sugar ring. For example, a modification of a sugar of a nucleotide may comprise a 2'-oxygen of a sugar is linked to a 1'-carbon or 4'-carbon of the sugar, or a 2'-oxygen is linked to the 1'-carbon or 4'-carbon via an ethylene or methylene bridge. In some embodiments, a modified nucleotide has an acyclic sugar that lacks a 2'-carbon to 3'-carbon bond. In some embodiments, a modified nucleotide has a thiol group, e.g., in the 4' position of the sugar.

In some embodiments, the oligonucleotide described herein comprises at least about 1 modified nucleotide (e.g., at least 1, at least 5, at least 10, at least 15, at least 20, at least 25, at least 30, at least 35, at least 40, at least 45, at least 50, at least 55, at least 60, or more). In some embodiments, the sense strand of the oligonucleotide comprises at least about 1 modified nucleotide (e.g., at least 1, at least 5, at least 10, at least 15, at least 20, at least 25, at least 30, at least 35, or more). In some embodiments, the antisense strand of the oligonucleotide comprises at least about 1 modified nucleotide (e.g., at least 1, at least 5, at least 10, at least 15, at least 20, or more).

In some embodiments, all the nucleotides of the sense strand of the oligonucleotide are modified. In some embodiments, all the nucleotides of the antisense strand of the oligonucleotide are modified. In some embodiments, all the nucleotides of the oligonucleotide (i.e., both the sense strand and the antisense strand) are modified. In some embodiments, the modified nucleotide comprises a 2'-modification (e.g., a 2'-F or 2'-OMe, 2'-MOE, and 2'-deoxy-2'-fluoro-β-d-arabinonucleic acid). In some embodiments, the modified nucleotide comprises a 2'-modification (e.g., a 2'-F or 2'-OMe).

In some embodiments, the disclosure provides oligonucleotides having different modification patterns. In some embodiments, an oligonucleotide herein comprises a sense strand having a modification pattern as set forth in the Examples and Sequence Listing and an antisense strand having a modification pattern as set forth in the Examples and Sequence Listing.

In some embodiments, an oligonucleotide disclosed herein (e.g., an RNAi oligonucleotide) comprises an antisense strand having nucleotides that are modified with 2'-F. In some embodiments, an oligonucleotide herein comprises an antisense strand comprising nucleotides that are modified with 2'-F and 2'-OMe. In some embodiments, an oligonucleotide disclosed herein comprises a sense strand having nucleotides that are modified with 2'-F. In some embodiments, an oligonucleotide disclosed herein comprises a sense strand comprises nucleotides that are modified with 2'-F and 2'-OMe.

In some embodiments, an oligonucleotide described herein comprises a sense strand with about 10-15%, 10%, 11%, 12%, 13%, 14% or 15% of the nucleotides of the sense strand comprising a 2'-fluoro modification. In some embodiments, about 11% of the nucleotides of the sense strand comprise a 2-fluoro modification. In some embodiments, an oligonucleotide described herein comprises an antisense strand with about 25-35%, 25%, 26%, 27%, 28%, 29%, 30%, 31%, 32%, 33%, 34% or 35% of the nucleotides of the antisense strand comprising a 2'-fluoro modification. In some embodiments, about 32% of the nucleotides of the antisense strand comprise a 2'-fluoro modification. In some embodiments, the oligonucleotide has about 15-25%, 15%, 16%, 17%, 18%, 19%, 20%, 21%, 22%, 23%, 24%, or 25% of its nucleotides comprising a 2'-fluoro modification. In some embodiments, about 19% of the nucleotides in the dsRNAi oligonucleotide comprise a 2'-fluoro modification.

In some embodiments, the modified oligonucleotides comprise a sense strand sequence having a modification pattern as set forth in FIG. 1 or Example 7 and an antisense strand having a modification pattern as set forth in FIG. 1 or Example 7. In some embodiments, for these oligonucleotides, one or more of positions 8, 9, 10 or 11 of the sense strand is modified with a 2'-F group. In other embodiments, for these oligonucleotides, the sugar moiety at each of nucleotides at positions 1-7 and 12-20 in the sense strand is modified with a 2'-OMe.

In some embodiments, the antisense strand has 3 nucleotides that are modified at the 2'-position of the sugar moiety with a 2'-F. In some embodiments, the sugar moiety at positions 2, 5 and 14 and optionally up to 3 of the nucleotides at positions 1, 3, 7 and 10 of the antisense strand are modified with a 2'-F. In some embodiments, the sugar moiety at positions 2, 5 and 14 and optionally up to 3 of the nucleotides at positions 3, 4, 7 and 10 of the antisense strand are modified with a 2'-F. In other embodiments, the sugar moiety at each of the positions at positions 2, 5 and 14 of the antisense strand is modified with the 2'-F. In other embodiments, the sugar moiety at each of the positions at positions 1, 2, 5 and 14 of the antisense strand is modified with the 2'-F. In other embodiments, the sugar moiety at each of the positions at positions 2, 4, 5 and 14 of the antisense strand is modified with the 2'-F. In still other embodiments, the sugar moiety at each of the positions at positions 1, 2, 3, 5, 7 and 14 of the antisense strand is modified with the 2'-F. In other embodiments, the sugar moiety at each of the positions at positions 2, 3, 4, 5, 7 and 14 of the antisense strand is modified with the 2'-F. In yet another embodiment, the sugar moiety at each of the positions at positions 1, 2, 3, 5, 10 and 14 of the antisense strand is modified with the 2'-F. In other embodiments, the sugar moiety at each of the positions at positions 2, 3, 4, 5, 10 and 14 of the antisense strand is modified with the 2'-F. In another embodiment, the sugar moiety at each of the positions at positions 2, 3, 5, 7, 10 and 14 of the antisense strand is modified with the 2'-F. In yet another embodiment, the sugar moiety at each of the positions at positions 2, 3, 4, 5, 7, 10 and 14 of the antisense strand is modified with the 2'-F.

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with 2'-F.

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with 2'-OMe.

In some embodiments, an oligonucleotide provided herein comprises an antisense strand having the sugar moiety at position 1, position 6, position 8, position 9, position 11, position 12, position 13, position 15, position 16, position 17, position 18, position 19, position 20, position 21, or position 22 modified with 2'-OMe.

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with a modification selected from the group consisting of 2'-O-propargyl, 2'-O-propylamin, 2'-amino, 2'-ethyl, 2'-aminoethyl (EA), 2'-O-methyl(2'-OMe), 2'-O-methoxyethyl(2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises a sense strand having the sugar moiety at positions 8-11 modified with 2'-F. In some embodiments, an oligonucleotide provided herein comprises a sense strand having the sugar moiety at positions 3, 8, 9, 10, 12, 13 and 17 modified with 2'-F. In some embodiments, an oligonucleotide provided herein comprises a sense strand having the sugar moiety at positions 1-7 and 12-17 or 12-20 modified with 2'OMe. In some embodiments, an oligonucleotide provided herein comprises a sense strand having the sugar moiety at positions 1-7, 12-27 and 31-36 modified with 2'OMe. In some embodiments, an oligonucleotide provided herein comprises a sense strand having the sugar moiety at positions 1-7 and 12-36 modified with 2'OMe. In some embodiments, an oligonucleotide provided herein comprises a sense strand having the sugar moiety of each of the nucleotides at positions 1-7 and 12-17 or 12-20 of the sense strand modified with a modification selected from the group consisting of 2'-O-propargyl, 2'-O-propylamin, 2'-amino, 2'-ethyl, 2'-aminoethyl (EA), 2'-O-methyl(2'-OMe), 2'-O-methoxyethyl(2'-MOE), 2'-O-[2-(methylamino)-2-oxoethyl] (2'-O-NMA), and 2'-deoxy-2'-fluoro-β-d-arabinonucleic acid (2'-FANA). In some embodiments, an oligonucleotide provided herein comprises a sense strand having the sugar moiety at positions 1-2, 4-7, 11, 14-16 and 18-20 modified with 2'OMe. In some embodiments, an oligonucleotide provided herein comprises a sense strand having the sugar moiety of each of the nucleotides at positions 1-2, 4-7, 11, 14-16 and 18-20 of the sense strand modified with a modification selected from the group consisting of 2'-O-propargyl, 2'-O-propylamin, 2'-amino, 2'-ethyl, 2'-aminoethyl (EA), 2'-O-methyl(2'-OMe), 2'-O-methoxyethyl(2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with 2'-F.

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with 2'-OMe.

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl(2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises a sense strand having the sugar moiety at positions 8-11 modified with 2'-F and the sugar moiety at positions 1-7 and 12-36 modified with 2'OMe, and an antisense strand with the sugar moiety at each of the positions at positions 2, 3, 4, 5, 7, 10 and 14 modified with the 2'-F and the sugar moiety at positions 1, 6, 8, 9, 11, 12, 13, 15, 16, 17, 18, 19, 20, 21, and 22 modified with 2'-OMe.

b. 5' Terminal Phosphates

In some embodiments, 5'-terminal phosphate groups of oligonucleotides enhance the interaction with Ago2. However, oligonucleotides comprising a 5'-phosphate group may be susceptible to degradation via phosphatases or other enzymes, which can limit their bioavailability in vivo. In some embodiments, oligonucleotides include analogs of 5' phosphates that are resistant to such degradation. In some embodiments, a phosphate analog may be oxymethylphosphonate, vinylphosphonate or malonyl phosphonate. In certain embodiments, the 1' end of an oligonucleotide strand is attached to chemical moiety that mimics the electrostatic and steric properties of a natural 5'-phosphate group ("phosphate mimic").

In some embodiments, an oligonucleotide has a phosphate analog at a 4'-carbon position of the sugar (referred to as a "4'-phosphate analog"). See, e.g., Intl. Patent Application Publication No. WO 2018/045317. In some embodiments, an oligonucleotide herein comprises a 4'-phosphate analog at a 5'-terminal nucleotide. In some embodiments, a phosphate analog is an oxymethylphosphonate, in which the oxygen atom of the oxymethyl group is bound to the sugar moiety (e.g., at its 4'-carbon) or analog thereof. In other embodiments, a 4'-phosphate analog is a thiomethyl phosphonate or an amino methyl phosphonate, in which the sulfur atom of the thiomethyl group or the nitrogen atom of the amino methyl group is bound to the 4'-carbon of the sugar moiety or analog thereof. In certain embodiments, a 4'-phosphate analog is an oxymethyl phosphonate. In some embodiments, an oxymethyl phosphonate is represented by the formula $-O-CH_2-PO(OH)_2$ or $-O-CH_2-PO(OR)_2$, in which R is independently selected from H, $CH_3$, an alkyl group, $CH_2CH_2CN$, $CH_2OCOC(CH_3)_3$, $CH_2OCH_2CH_2Si(CH_3)_3$ or a protecting group. In certain embodiments, the alkyl group is $CH_2CH_3$. More typically, R is independently selected from H, $CH_3$ or $CH_2CH_3$.

In some embodiments, an oligonucleotide provided herein comprises an antisense strand comprising a 4'-phosphate analog at the 5'-terminal nucleotide, wherein 5'-terminal nucleotide comprises the following structure:

Chem 1

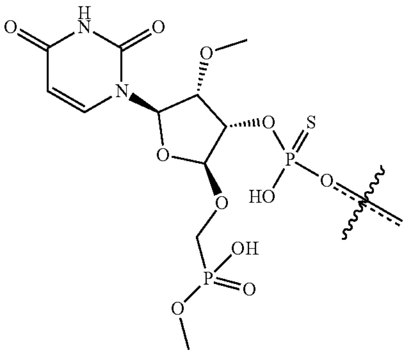

4'O-monomethylphosphonate-2'-O-methyluridine phosphorothioate [MePhosphonate-4O-mUs].

c. Modified Internucleotide Linkages

In some embodiments, an oligonucleotide may comprise a modified internucleoside linkage. In some embodiments, phosphate modifications or substitutions may result in an oligonucleotide that comprises at least about 1 (e.g., at least 1, at least 2, at least 3 or at least 5) modified internucleotide linkage. In some embodiments, any one of the oligonucleotides disclosed herein comprises about 1 to about 10 (e.g., 1 to 10, 2 to 8, 4 to 6, 3 to 10, 5 to 10, 1 to 5, 1 to 3 or 1 to 2) modified internucleotide linkages. In some embodiments, any one of the oligonucleotides disclosed herein comprises 1, 2, 3, 4, 5, 6, 7, 8, 9 or 10 modified internucleotide linkages.

A modified internucleotide linkage may be a phosphorodithioate linkage, 4'-O-methylene phosphonate linkage, a phosphorothioate linkage, a phosphotriester linkage, a thionoalkylphosphonate linkage, a thionalkylphosphotriester linkage, a phosphoramidite linkage, a phosphonate linkage or a boranophosphate linkage. In some embodiments, at least one modified internucleotide linkage of any one of the oligonucleotides as disclosed herein is a phosphorothioate linkage. In some embodiments, at least one modified internucleotide linkage of any one of the oligonucleotides as disclosed herein is a 4'-O-methylene phosphonate linkage.

In some embodiments, the oligonucleotide described herein has a phosphorothioate linkage between one or more of positions 1 and 2 of the sense strand, positions 1 and 2 of the antisense strand, positions 2 and 3 of the antisense strand, positions 3 and 4 of the antisense strand, positions 20 and 21 of the antisense strand, and positions 21 and 22 of the antisense strand. In some embodiments, the oligonucleotide described herein has a phosphorothioate linkage between each of positions 1 and 2 of the sense strand, positions 1 and 2 of the antisense strand, positions 2 and 3 of the antisense strand, positions 20 and 21 of the antisense strand, and positions 21 and 22 of the antisense strand.

d. Base Modifications

In some embodiments, oligonucleotides herein have one or more modified nucleobases. In some embodiments, modified nucleobases (also referred to herein as base analogs) are linked at the 1' position of a nucleotide sugar moiety. In certain embodiments, a modified nucleobase is a nitrogenous base. In certain embodiments, a modified nucleobase does not contain nitrogen atom. See, e.g., US Patent Application Publication No. 2008/0274462. In some embodiments, a modified nucleotide comprises a universal base. However, in certain embodiments, a modified nucleotide does not contain a nucleobase (abasic).

In some embodiments, a universal base is a heterocyclic moiety located at the 1' position of a nucleotide sugar moiety in a modified nucleotide, or the equivalent position in a nucleotide sugar moiety substitution, that, when present in a duplex, can be positioned opposite more than one type of base without substantially altering structure of the duplex. In some embodiments, compared to a reference single-stranded nucleic acid (e.g., oligonucleotide) that is fully complementary to a target nucleic acid, a single-stranded nucleic acid containing a universal base forms a duplex with the target nucleic acid that has a lower $T_m$ than a duplex formed with the complementary nucleic acid. However, in some embodiments, when compared to a reference single-stranded nucleic acid in which the universal base has been replaced with a base to generate a single mismatch, the single-stranded nucleic acid containing the universal base forms a duplex with the target nucleic acid that has a higher $T_m$ than a duplex formed with the nucleic acid comprising the mismatched base.

Non-limiting examples of universal-binding nucleotides include, but are not limited to, inosine, 1-β-D-ribofuranosyl-5-nitroindole and/or 1-β-D-ribofuranosyl-3-nitropyrrole (see, US Patent Application Publication No. 2007/0254362; Van Aerschot et al., (1995) Nucleic Acids Res. 23:4363-4370; Loakes et al., (1995) Nucleic Acids Res. 23:2361-66; and Loakes and Brown (1994) Nucleic Acids Res. 22:4039-43).

e. Reversible Modifications

While certain modifications to protect an oligonucleotide from the in vivo environment before reaching target cells can be made, they can reduce the potency or activity of the oligonucleotide once it reaches the cytosol of the target cell. Reversible modifications can be made such that the molecule retains desirable properties outside of the cell, which are then removed upon entering the cytosolic environment of the cell. Reversible modification can be removed, for example, by the action of an intracellular enzyme or by the chemical conditions inside of a cell (e.g., through reduction by intracellular glutathione).

In some embodiments, a reversibly modified nucleotide comprises a glutathione-sensitive moiety. Typically, nucleic acid molecules have been chemically modified with cyclic disulfide moieties to mask the negative charge created by the internucleotide diphosphate linkages and improve cellular uptake and nuclease resistance. See US Patent Application Publication No. 2011/0294869, Intl. Patent Application Publication Nos. WO 2014/088920 and WO 2015/188197, and Meade et al., (2014) Nat. Biotechnol. 32:1256-63. This reversible modification of the internucleotide diphosphate linkages is designed to be cleaved intracellularly by the reducing environment of the cytosol (e.g., glutathione). Earlier examples include neutralizing phosphotriester modifications that were reported to be cleavable inside cells (see, Dellinger et al., (2003) J. Am. Chem. Soc. 125:940-50).

In some embodiments, such a reversible modification allows protection during in vivo administration (e.g., transit through the blood and/or lysosomal/endosomal compartments of a cell) where the oligonucleotide will be exposed to nucleases and other harsh environmental conditions (e.g., pH). When released into the cytosol of a cell where the levels of glutathione are higher compared to extracellular space, the modification is reversed, and the result is a cleaved oligonucleotide. Using reversible, glutathione-sensitive moieties, it is possible to introduce sterically larger chemical groups into the oligonucleotide of interest when compared to the options available using irreversible chemical modifications. This is because these larger chemical groups will be removed in the cytosol and, therefore, should not interfere with the biological activity of the oligonucleotides inside the cytosol of a cell. As a result, these larger chemical groups can be engineered to confer various advantages to the nucleotide or oligonucleotide, such as nuclease resistance, lipophilicity, charge, thermal stability, specificity, and reduced immunogenicity. In some embodiments, the structure of the glutathione-sensitive moiety can be engineered to modify the kinetics of its release.

In some embodiments, a glutathione-sensitive moiety is attached to the sugar of the nucleotide. In some embodiments, a glutathione-sensitive moiety is attached to the 2'-carbon of the sugar of a modified nucleotide. In some embodiments, the glutathione-sensitive moiety is located at the 5'-carbon of a sugar, particularly when the modified nucleotide is the 5'-terminal nucleotide of the oligonucleotide. In some embodiments, the glutathione-sensitive moiety is located at the 3'-carbon of sugar, particularly when the modified nucleotide is the 3'-terminal nucleotide of the oligonucleotide. In some embodiments, the glutathione-sensitive moiety comprises a sulfonyl group. See, e.g., U.S. Provisional Patent Application No. 62/378,635, entitled Compositions Comprising Reversibly Modified Oligonucleotides and Uses Thereof, which was filed on Aug. 23, 2016.

Targeting Ligands

In some embodiments, it is desirable to target the STAT3 targeting oligonucleotides of the disclosure to one or more cells or one or more organs. Such a strategy can help to avoid undesirable effects in other organs or avoid undue loss of the oligonucleotide to cells, tissue or organs that would not benefit from the oligonucleotide. Targeting of oligonucleotides to one or more cells or one or more organs can be achieved through a variety of approaches. Conjugation of oligonucleotides to tissue or cell specific antibodies, small molecules or targeting ligands can facilitate delivery to and modify accumulation of the oligonucleotide in one or more target cells or tissues (Chernolovskaya et al., (2019) Front Pharmacol. 10:444). For example, conjugation of an oligonucleotide to a saturated fatty acid (e.g., C22) may facilitate delivery to cells or tissues like adipose tissue or immune cells which uptake such ligands more readily than conventional oligonucleotide ligands. Accordingly, in some embodiments, oligonucleotides disclosed herein are modified to facilitate targeting and/or delivery of a tissue, cell, or organ (e.g., to facilitate delivery of the oligonucleotide to the liver). In certain embodiments, oligonucleotides disclosed herein are modified to facilitate delivery of the oligonucleotide to cells of the immune system. In certain embodiments, oligonucleotides disclosed herein are modified to facilitate delivery of the oligonucleotide to myeloid derived suppressor cells. In some embodiments, an oligonucleotide comprises at least one nucleotide (e.g., 1, 2, 3, 4, 5, 6 or more nucleotides) conjugated to one or more targeting ligand(s).

In some embodiments, the targeting ligand comprises a carbohydrate, amino sugar, cholesterol, peptide, polypeptide, protein, or part of a protein (e.g., an antibody or antibody fragment), or lipid. In some embodiments, the targeting ligand is an aptamer. For example, a targeting ligand may be an RGD peptide that is used to target tumor vasculature or glioma cells, CREKA peptide to target tumor vasculature or stoma, transferring, lactoferrin, or an aptamer to target transferrin receptors expressed on CNS vasculature, or an anti-EGFR antibody to target EGFR on glioma cells. In certain embodiments, the targeting ligand is one or more GalNAc moieties.

In some embodiments, 1 or more (e.g., 1, 2, 3, 4, 5 or 6) nucleotides of an oligonucleotide are each conjugated to a separate targeting ligand. In some embodiments, 2 to 4 nucleotides of an oligonucleotide are each conjugated to a separate targeting ligand. In some embodiments, targeting ligands are conjugated to 2 to 4 nucleotides at either ends of the sense or antisense strand (e.g., targeting ligands are conjugated to a 2 to 4 nucleotide overhang or extension on the 5' or 3' end of the sense or antisense strand) such that the targeting ligands resemble bristles of a toothbrush and the oligonucleotide resembles a toothbrush. For example, an oligonucleotide may comprise a stem-loop at either the 5' or 3' end of the sense strand and 1, 2, 3 or 4 nucleotides of the loop of the stem may be individually conjugated to a targeting ligand. In some embodiments, an oligonucleotide (e.g., a dsRNA) provided by the disclosure comprises a stem-loop at the 3' end of the sense strand, wherein the loop of the stem-loop comprises a triloop or a tetraloop, and wherein the 3 or 4 nucleotides comprising the triloop or tetraloop, respectfully, are individually conjugated to a targeting ligand. In some embodiments, an oligonucleotide provided by the disclosure (e.g., a RNAi oligonucleotide) comprises a stem-loop at the 3' terminus of the sense strand, wherein the loop of the stem-loop comprises a tetraloop, and wherein 3 nucleotides of the tetraloop are individually conjugated to a targeting ligand.

GalNAc is a high affinity ligand for the ASGPR, which is primarily expressed on the sinusoidal surface of hepatocyte cells and has a major role in binding, internalizing and subsequent clearing circulating glycoproteins that contain terminal galactose or GalNAc residues (asialoglycoproteins). Conjugation (either indirect or direct) of GalNAc moieties to oligonucleotides of the instant disclosure can be used to target these oligonucleotides to the ASGPR expressed on cells. In some embodiments, an oligonucleotide of the instant disclosure is conjugated to at least one or more GalNAc moieties, wherein the GalNAc moieties target the oligonucleotide to an ASGPR expressed on human liver cells (e.g., human hepatocytes). In some embodiments, the GalNAc moiety target the oligonucleotide to the liver.

In some embodiments, an oligonucleotide of the instant disclosure is conjugated directly or indirectly to a monovalent GalNAc. In some embodiments, the oligonucleotide is conjugated directly or indirectly to more than one monovalent GalNAc (i.e., is conjugated to 2, 3 or 4 monovalent GalNAc moieties, and is typically conjugated to 3 or 4 monovalent GalNAc moieties). In some embodiments, an oligonucleotide is conjugated to one or more bivalent GalNAc, trivalent GalNAc or tetravalent GalNAc moieties.

In some embodiments, 1 or more (e.g., 1, 2, 3, 4, 5 or 6) nucleotides of an oligonucleotide are each conjugated to a GalNAc moiety. In some embodiments, 2 to 4 nucleotides of a tetraloop are each conjugated to a separate GalNAc. In some embodiments, 1 to 3 nucleotides of a triloop are each conjugated to a separate GalNAc. In some embodiments, targeting ligands are conjugated to 2 to 4 nucleotides at either ends of the sense or antisense strand (e.g., ligands are conjugated to a 2 to 4 nucleotide overhang or extension on the 5' or 3' end of the sense or antisense strand) such that the GalNAc moieties resemble bristles of a toothbrush and the oligonucleotide resembles a toothbrush. In some embodiments, GalNAc moieties are conjugated to a nucleotide of the sense strand. For example, 4 GalNAc moieties can be conjugated to nucleotides in the tetraloop of the sense strand where each GalNAc moiety is conjugated to 1 nucleotide.

In some embodiments, the tetraloop is any combination of adenine and guanine nucleotides.

In some embodiments, the tetraloop (tetraL) has a monovalent GalNAc moiety attached to any one or more guanine nucleotides of the tetraloop via any linker described herein, as depicted below in Chem 2 (X=heteroatom):

Chem 2

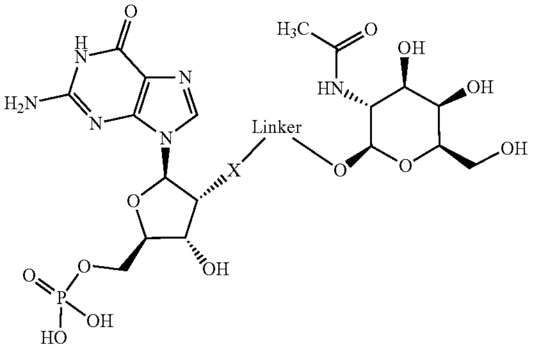

In some embodiments, the tetraloop (tetraL) has a monovalent GalNAc attached to any one or more adenine nucleotides of the tetraloop via any linker described herein, as depicted below in Chem 3 (X=heteroatom):

Chem 3

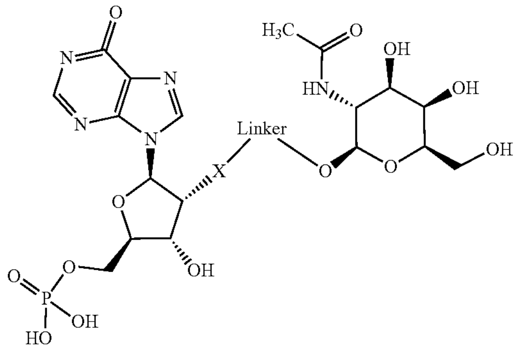

In some embodiments, an oligonucleotide herein comprises a monovalent GalNAc attached to a guanine nucleotide referred to as [ademG-GalNAc] or 2'-aminodiethoxymethanol-Guanine-GalNAc, as depicted below in Chem 4:

Chem 4

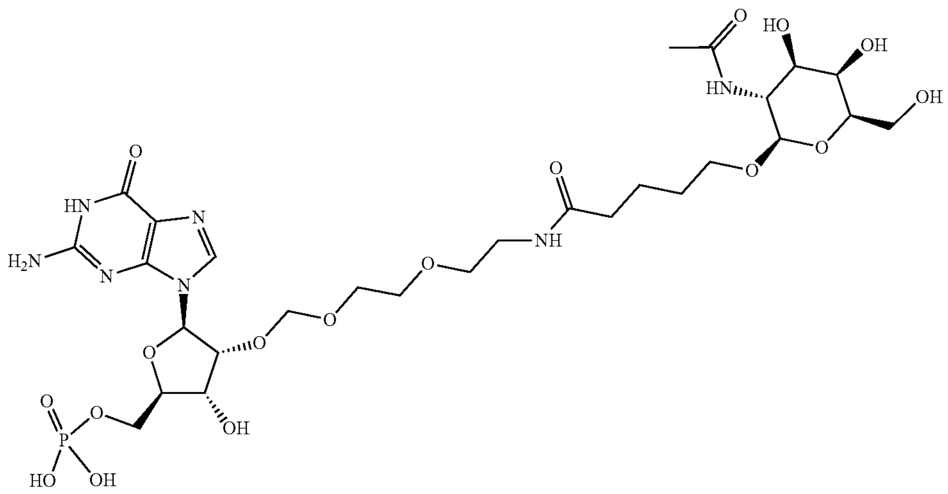

In some embodiments, an oligonucleotide herein comprises a monovalent GalNAc attached to an adenine nucleotide, referred to as [ademA-GalNAc] or 2'-aminodiethoxymethanol-Adenine-GalNAc, as depicted below in Chem 5:

Chem 5

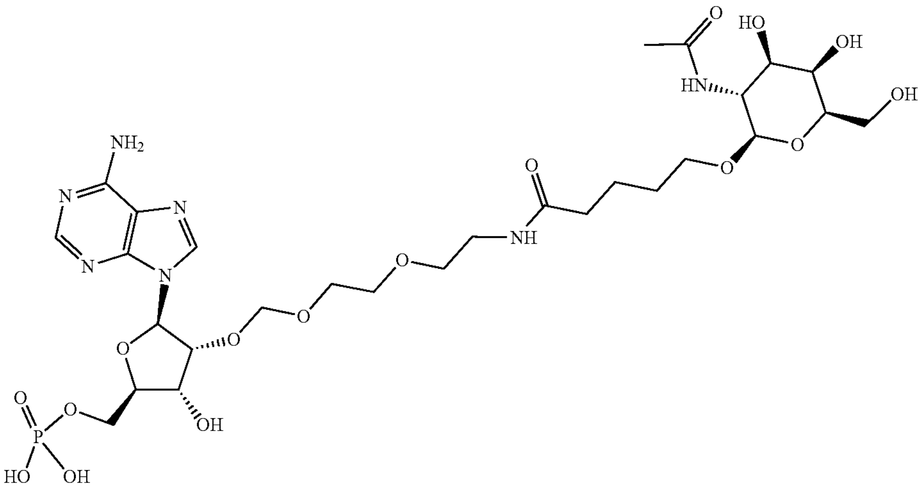

An example of such conjugation is shown below (Chem 6) for a loop comprising from 5' to 3' the nucleotide sequence GAAA (L=linker, X=heteroatom) stem attachment points are shown. Such a loop may be present, for example, at positions 27-30 of the sense strand as shown in FIG. 1. In the chemical formula,

is used to describe an attachment point to the oligonucleotide strand(Chem 6).

Chem 6

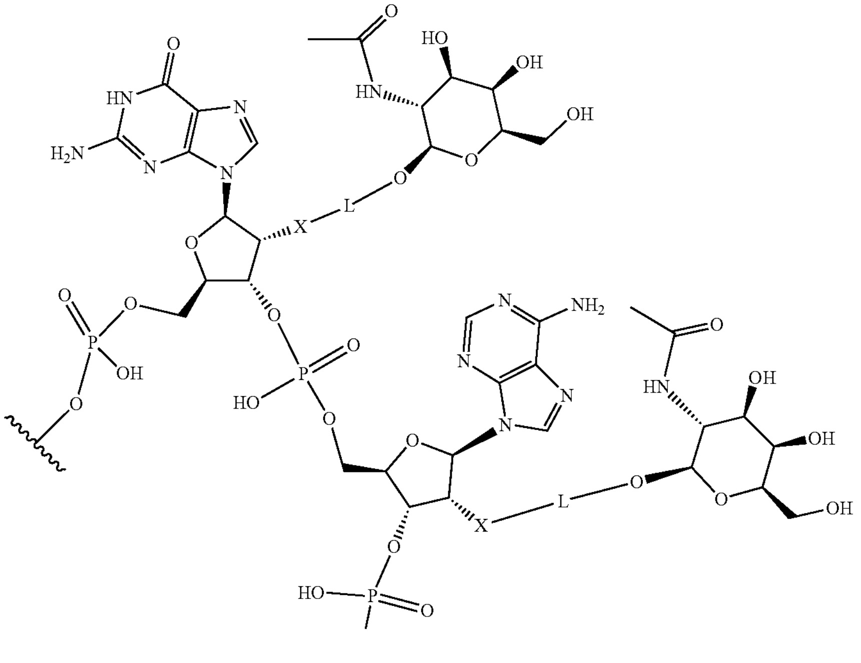

-continued

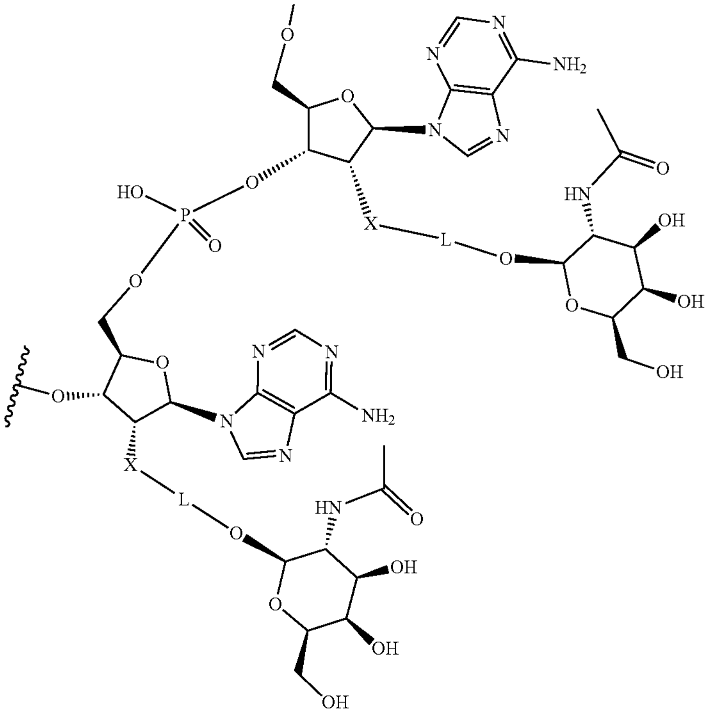

Appropriate methods or chemistry (e.g., click chemistry) can be used to link a targeting ligand to a nucleotide. In some embodiments, a targeting ligand is conjugated to a nucleotide using a click linker. In some embodiments, an acetal-based linker is used to conjugate a targeting ligand to a nucleotide of any one of the oligonucleotides described herein. Acetal-based linkers are disclosed, for example, in Intl. Patent Application Publication No. WO 2016/100401. In some embodiments, the linker is a labile linker. However, in other embodiments, the linker is stable. Examples are shown below for a loop comprising from 5' to 3' the nucleotides GAAA, in which GalNAc moieties are attached to nucleotides of the loop using an acetal linker (Chem 7 and Chem 8). Such a loop may be present, for example, at positions 27-30 of the any one of the sense strand as shown in FIG. 1. In the chemical formula,

is an attachment point to the oligonucleotide strand(Chem 7 and Chem 8).

Chem 6

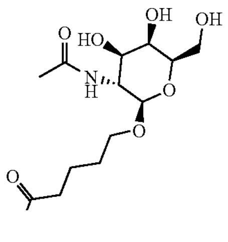

-continued
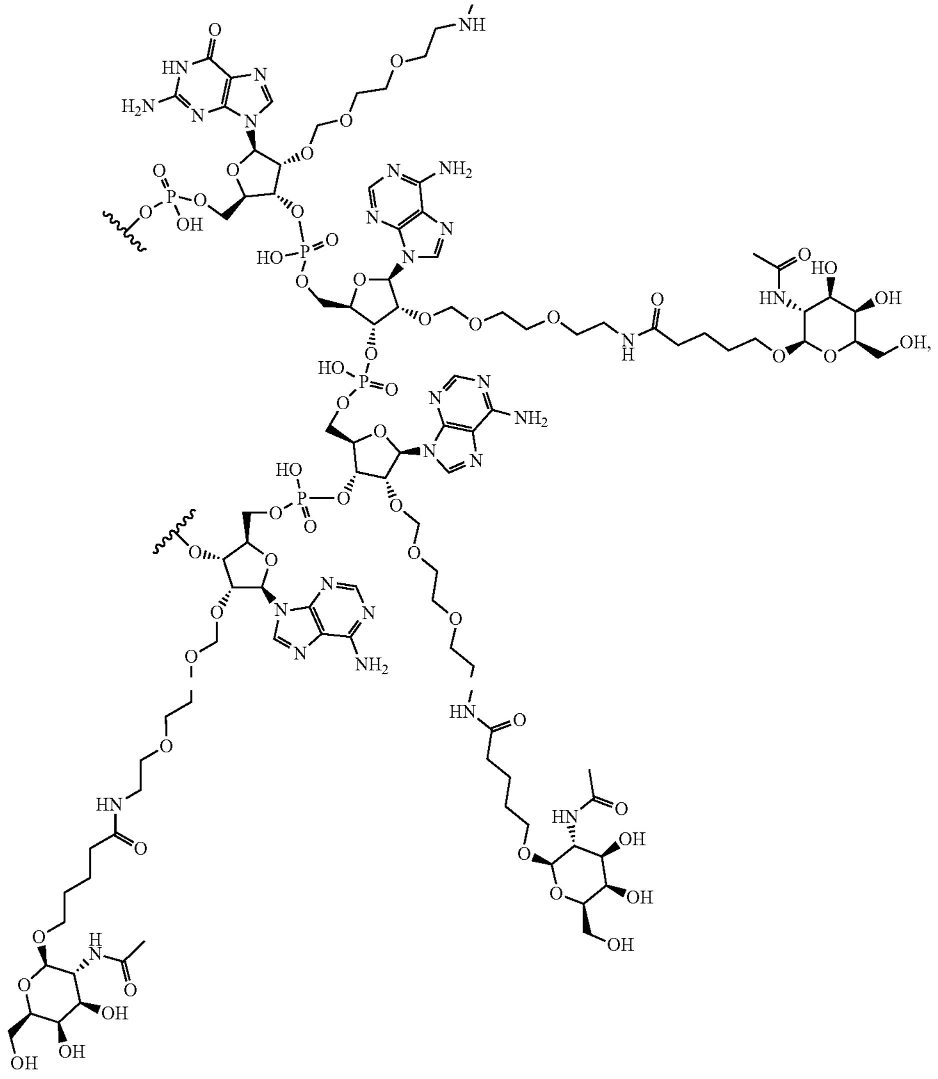
or
Chem 7
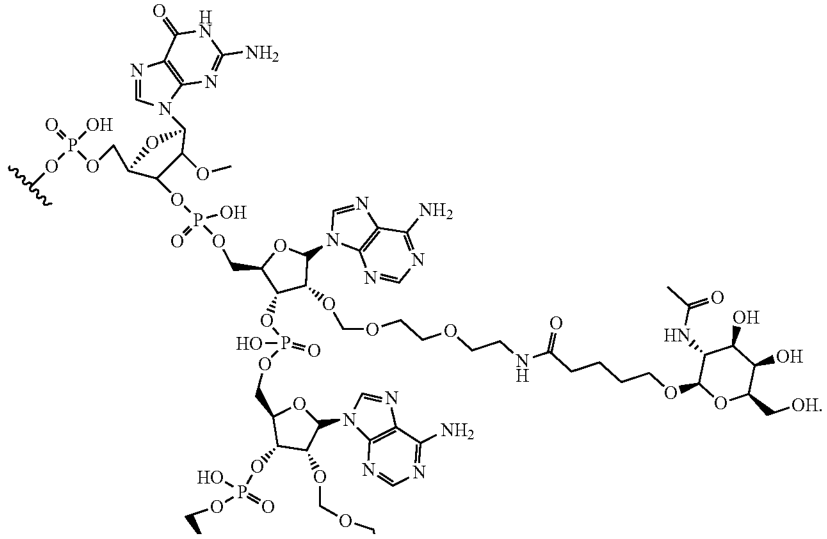

-continued

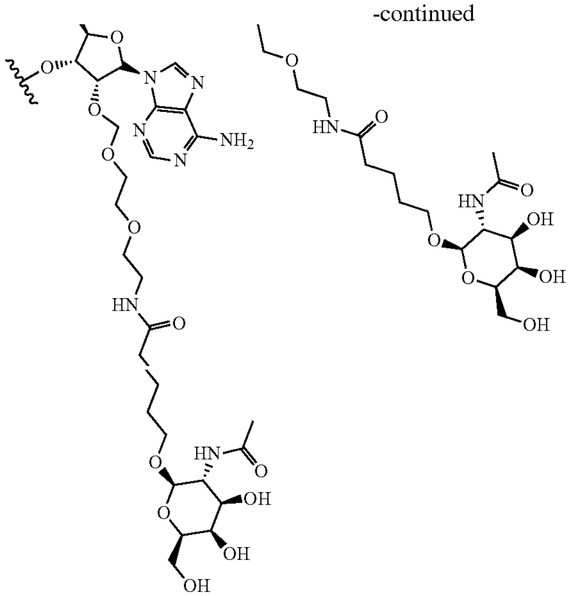

As mentioned, various appropriate methods or chemistry synthetic techniques (e.g., click chemistry) can be used to link a targeting ligand to a nucleotide. In some embodiments, a targeting ligand is conjugated to a nucleotide using a click linker. In some embodiments, an acetal-based linker is used to conjugate a targeting ligand to a nucleotide of any one of the oligonucleotides described herein. Acetal-based linkers are disclosed, for example, in Intl. Patent Application Publication No. WO 2016/100401. In some embodiments, the linker is a labile linker. However, in other embodiments, the linker is a stable linker.

In some embodiments, a duplex extension (e.g., of up to 3, 4, 5 or 6 bp in length) is provided between a targeting ligand (e.g., a GalNAc moiety) and a dsRNA. In some embodiments, the oligonucleotides herein do not have a GalNAc conjugated thereto.

Structure of Conjugated STAT3 Targeting Oligonucleotides

In some embodiments, a STAT3 targeting oligonucleotide described herein comprises a nucleotide sequence having a region of complementarity to a STAT3 mRNA target sequence and one or more targeting ligands, wherein the nucleotide sequence comprises one or more nucleosides (nucleic acids) conjugated with one or more targeting ligands represented by formula I-a:

I-a

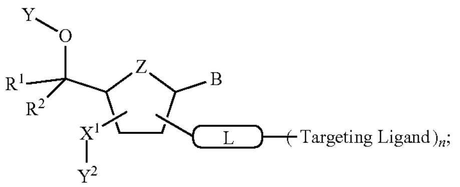

or a pharmaceutically acceptable salt thereof, wherein:

B is a nucleobase or hydrogen;

$R^1$ and $R^2$ are independently hydrogen, halogen, $R^A$, —CN, —S(O)R, —$S(O)_2R$, —$Si(OR)_2R$, —$Si(OR)R_2$, or —$SiR_3$; or $R^1$ and $R^2$ on the same carbon are taken together with their intervening atoms to form a 3-7 membered saturated or partially unsaturated ring having 0-3 heteroatoms, independently selected from nitrogen, oxygen, and sulfur;

each $R^A$ is independently an optionally substituted group selected from $C_{1-6}$ aliphatic, phenyl, a 4-7 membered saturated or partially unsaturated heterocyclic ring having 1-2 heteroatoms independently selected from nitrogen, oxygen, and sulfur, and a 5-6 membered heteroaryl ring having 1-4 heteroatoms independently selected from nitrogen, oxygen, and sulfur;

each R is independently hydrogen, a suitable protecting group, or an optionally substituted group selected from $C_{1-6}$ aliphatic, phenyl, a 4-7 membered saturated or partially unsaturated heterocyclic having 1-2 heteroatoms independently selected from nitrogen, oxygen, and sulfur, and a 5-6 membered heteroaryl ring having 1-4 heteroatoms independently selected from nitrogen, oxygen, and sulfur; or two R groups on the same atom are taken together with their intervening atoms to form a 4-7 membered saturated, partially unsaturated, or heteroaryl ring having 0-3 heteroatoms, independently selected from nitrogen, oxygen, silicon, and sulfur;

each targeting ligand is selected from lipid conjugate moiety (LC), carbohydrate, amino sugar or GalNAc; and wherein each LC is independently a lipid conjugate moiety comprising a saturated or unsaturated, straight, or branched $C_{1-50}$ hydrocarbon chain, wherein 0-10 methylene units of the hydrocarbon chain are independently replaced by -Cy-, —O—, —C(O)NR—, —NR—, —S—, —C(O)—, —C(O)O—, —S(O)—, —$S(O)_2$—, —P(O)OR—, —P(S)OR—;

each -Cy- is independently an optionally substituted bivalent ring selected from phenylenyl, an 8-10 membered bicyclic arylenyl, a 4-7 membered saturated or partially unsaturated carbocyclylenyl, a 4-11 membered saturated or partially unsaturated spiro carbocyclylenyl, an 8-10 membered bicyclic saturated or partially unsaturated carbocyclylenyl, a 4-7 membered saturated or partially unsaturated heterocyclylenyl having 1-3 heteroatoms independently selected from nitrogen, oxygen, and sulfur, a 4-11 membered saturated or partially unsaturated spiro heterocyclylenyl having 1-2 heteroatoms independently selected from nitrogen, oxygen, and sulfur, an 8-10 membered bicyclic saturated or partially unsaturated heterocyclylenyl having 1-2 heteroatoms independently selected from nitrogen, oxygen, and sulfur, a 5-6 membered heteroarylenyl having 1-4 heteroatoms independently selected from nitrogen, oxygen, and sulfur, or an 8-10 membered bicyclic heteroarylenyl having 1-5 heteroatoms independently selected from nitrogen, oxygen, or sulfur;

n is 1-10;

L is a covalent bond or a bivalent saturated or unsaturated, straight or branched $C_{1-50}$ hydrocarbon chain, wherein 0-10 methylene units of the hydrocarbon chain are independently replaced by -Cy-, —O—, —C(O)NR—, —NR—, —S—, —C(O)—, —C(O)O—, —S(O)—, —$S(O)_2$—, —P(O)OR—, —P(S)OR—, —$V^1CR^2W^1$—, or

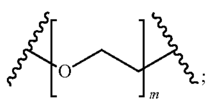

m is 1-50;

$X^1$, $V^1$ and $W^1$ are independently —$C(R)_2$—, —OR, —O—, —S—, —Se—, or —NR—;

Y is hydrogen, a suitable hydroxyl protecting group,

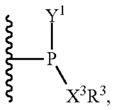

or

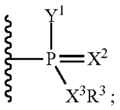

$R^3$ is hydrogen, a suitable protecting group, a suitable prodrug, or an optionally substituted group selected from $C_{1-6}$ aliphatic, phenyl, a 4-7 membered saturated or partially unsaturated heterocyclic ring having 1-2 heteroatoms independently selected from nitrogen, oxygen, and sulfur, and a 5-6 membered heteroaryl ring having 1-4 heteroatoms independently selected from nitrogen, oxygen, and sulfur;

$X^2$ is O, S, or NR;

$X^3$ is —O—, —S—, —$BH_2$—, or a covalent bond;

$Y^1$ is a linking group attaching to the 2'- or 3'-terminal of a nucleoside, a nucleotide, or an oligonucleotide;

$Y^2$ is hydrogen, a suitable protecting group, a phosphoramidite analogue, an internucleotide linking group attaching to the 5'-terminal of a nucleoside, a nucleotide, or an oligonucleotide, or a linking group attaching to a solid support; and Z is —O—, —S—, —NR—, or —$CR_2$—.

In some embodiments, the STAT3 targeting oligonucleotide comprises one or more nucleic acids conjugated with targeting ligands represented by formula II-a:

II-a

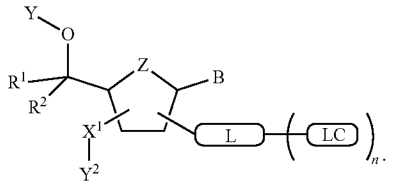

or a pharmaceutically acceptable salt thereof.

In some embodiments, the STAT3 targeting oligonucleotide comprises one or more nucleic acids conjugated with targeting ligands represented by formula II-b or II-c:

II-b

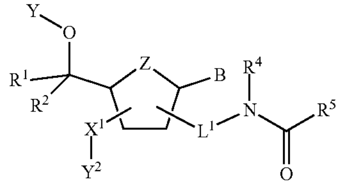

II-c

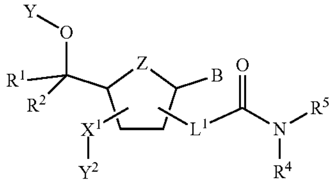

or a pharmaceutically acceptable salt thereof, wherein:

$L^1$ is a covalent bond, a monovalent or a bivalent saturated or unsaturated, straight or branched $C_{1-50}$ hydrocarbon chain, wherein 0-10 methylene units of the hydrocarbon chain are independently replaced by -Cy-, —O—, —C(O)NR—, —NR—, —S—, —C(O)—, —C(O)O—, —S(O)—, —$S(O)_2$—, —P(O)OR—, —P(S)OR—, or

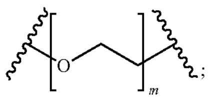

$R^4$ is hydrogen, $R^A$, or a suitable amine protection group; and $R^5$ is adamantyl, or a saturated or unsaturated, straight, or branched $C_{1-50}$ hydrocarbon chain, wherein 0-10 methylene units of the hydrocarbon chain are independently replaced by —O—, —C(O)NR—, —NR—, —S—, —C(O)—, —C(O)O—, —S(O)—, —$S(O)_2$—, —P(O)OR—, or —P(S)OR.

In some embodiments, $R^5$ is selected from
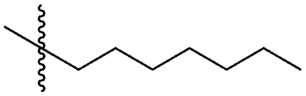, 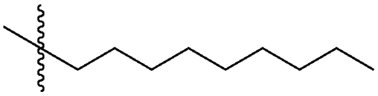, 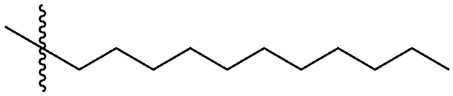,
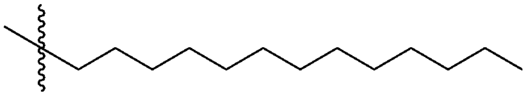, 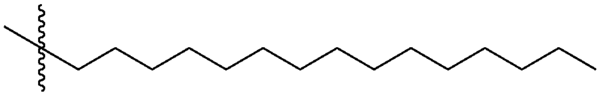,
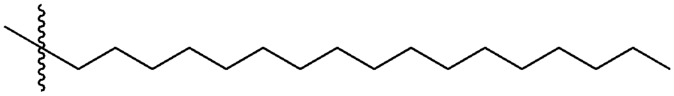,
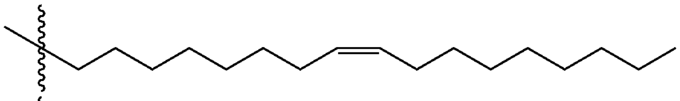,
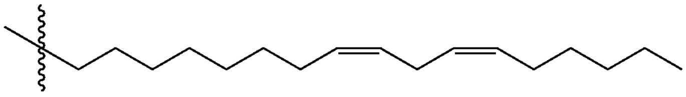,
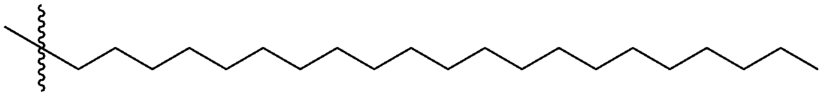,
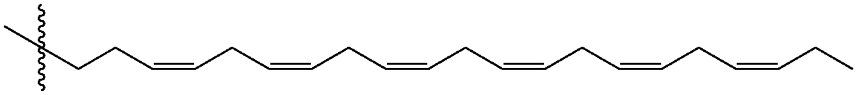,
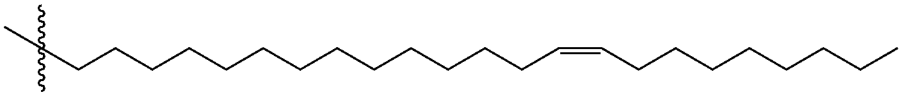,
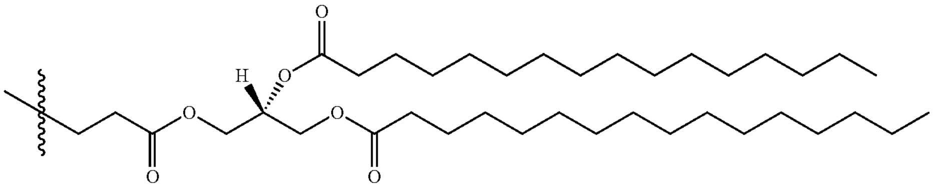,
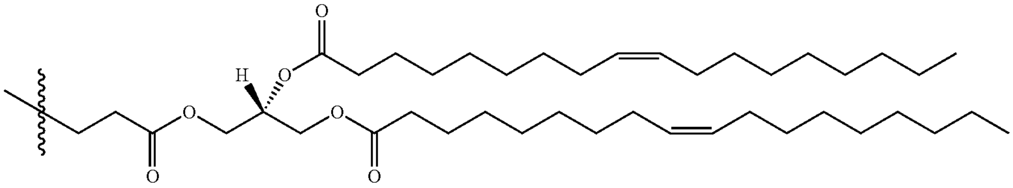, and
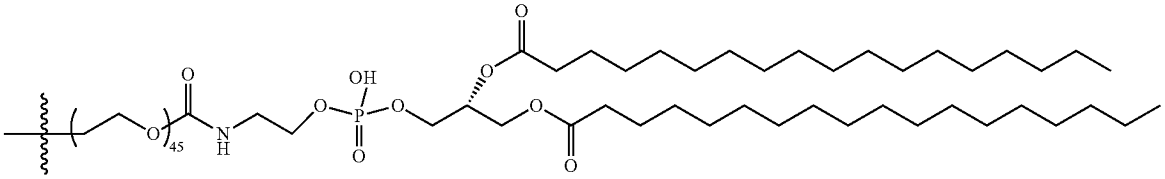.
In some embodiments, $R^5$ is selected from:
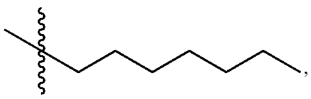, 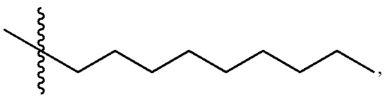, 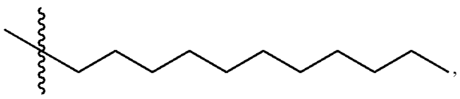,
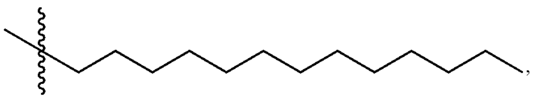, 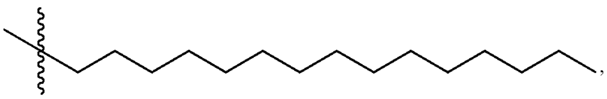, -continued
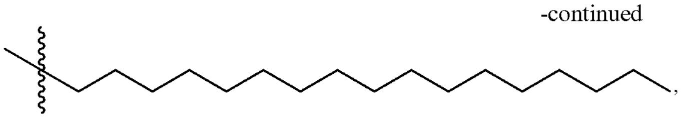
,
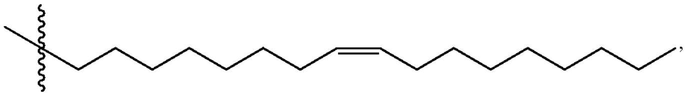
,
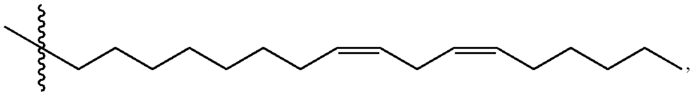
,
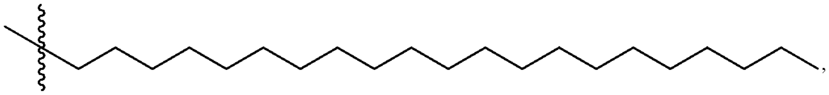
,
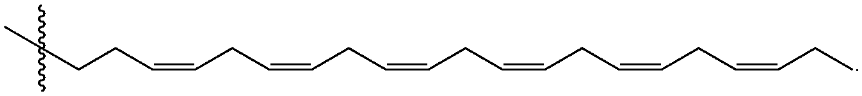
.
In some embodiments, $R^5$ is
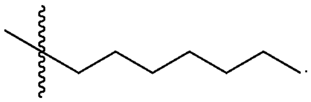 [SMILES: *CCCCCCC]
.
In some embodiments, $R^5$ is
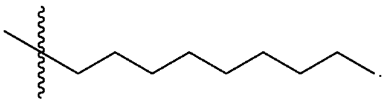 [SMILES: *CCCCCCCCC]
.
In some embodiments, $R^5$ is
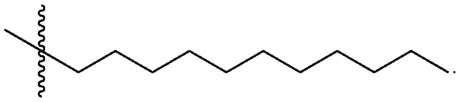 [SMILES: *CCCCCCCCCCC]
.
In some embodiments, $R^5$ is
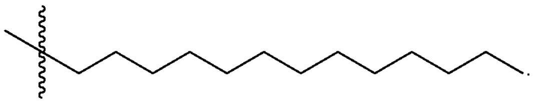 [SMILES: *CCCCCCCCCCCCC]
.
In some embodiments, $R^5$ is
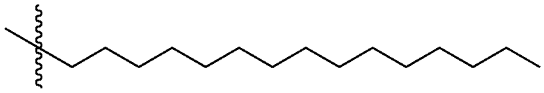
.
In some embodiments, $R^5$ is
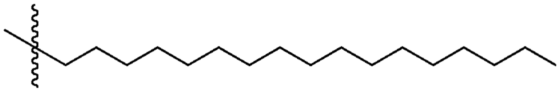
.
In some embodiments, $R^5$ is
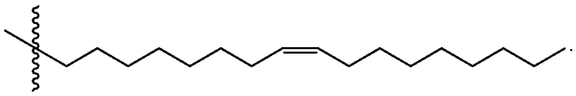 [SMILES: *CCCCCCC/C=C\CCCCCCCC]
.
In some embodiments, $R^5$ is
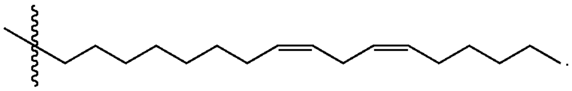 [SMILES: *CCCCCCC/C=C\C/C=C\CCCCC]
.
In some embodiments, $R^5$ is
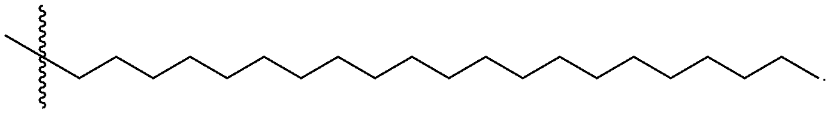 [SMILES: *CCCCCCCCCCCCCCCCCCCCC]
.

In some embodiments, $R^5$ is
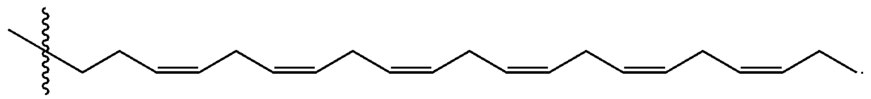
In some embodiments, $R^5$ is
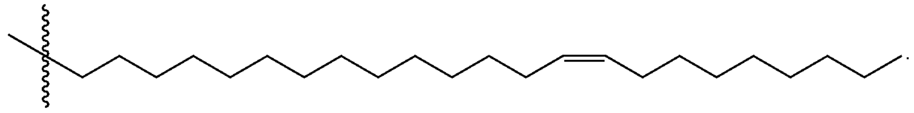 [SMILES: *CCCCCCCCCCCCC/C=C\CCCCCCCC]
In some embodiments, $R^5$ is
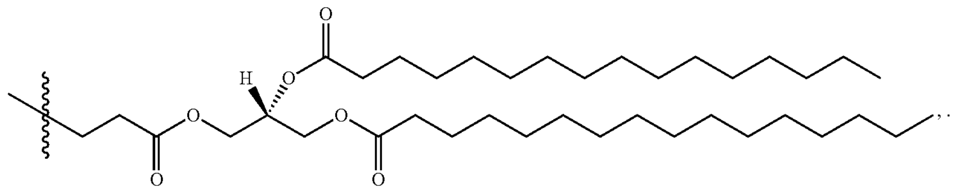 [SMILES: *CCC(=O)OC[C@@H](COC(=O)CCCCCCCCCCCCCCC)OC(=O)CCCCCCCCCCCCCCC]
In some embodiments, $R^5$ is
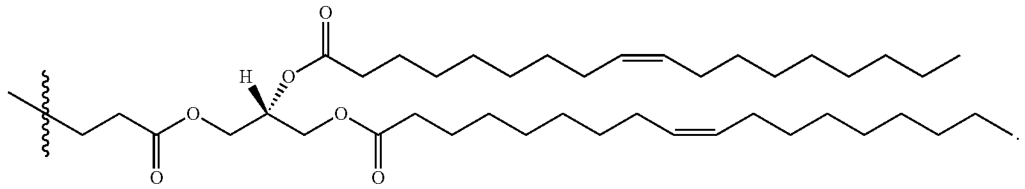 [SMILES: *CCC(=O)OC[C@@H](COC(=O)CCCCCCC/C=C\CCCCCCCC)OC(=O)CCCCCCC/C=C\CCCCCCCC]
In some embodiments, $R^5$ is
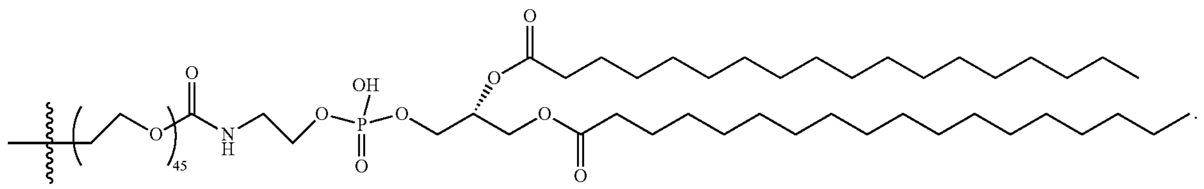

In some embodiments, the STAT3 targeting oligonucleotide comprises one or more nucleic acids conjugated with targeting ligands represented by formula II-Ib or II-Ic:

II-Ib

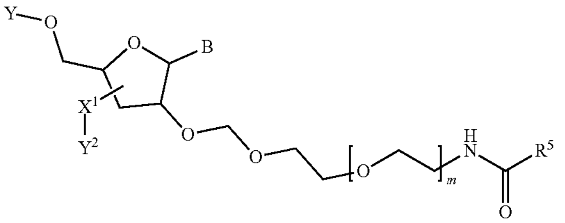

II-Ic

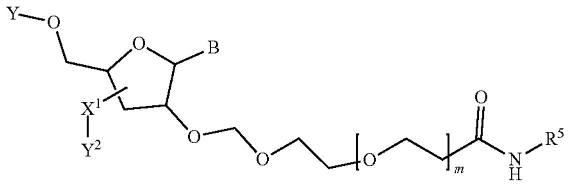

or a pharmaceutically acceptable salt thereof; wherein

B is a nucleobase or hydrogen;

m is 1-50;

$X^1$ is —O—, or —S—;

Y is hydrogen,

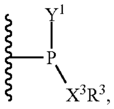, or 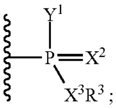;

$R^3$ is hydrogen, or a suitable protecting group;

$X^2$ is O, or S;

$X^3$ is —O—, —S—, or a covalent bond;

$Y^1$ is a linking group attaching to the 2'- or 3'-terminal of a nucleoside, a nucleotide, or an oligonucleotide;

$Y^2$ is hydrogen, a phosphoramidite analogue, an internucleotide linking group attaching to the 5'-terminal of a nucleoside, a nucleotide, or an oligonucleotide, or a linking group attaching to a solid support;

$R^5$ is adamantyl, or a saturated or unsaturated, straight, or branched $C_{1-50}$ hydrocarbon chain, wherein 0-10 methylene units of the hydrocarbon chain are independently replaced by —O—, —C(O)NR—, —NR—, —S—, —C(O)—, —C(O)O—, —S(O)—, —S(O)$_2$—, —P(O)OR—, or —P(S)OR—; and R is hydrogen, a suitable protecting group, or an optionally substituted group selected from $C_{1-6}$ aliphatic, phenyl, a 4-7 membered saturated or partially unsaturated heterocyclic having 1-2 heteroatoms independently selected from nitrogen, oxygen, and sulfur, and a 5-6 membered heteroaryl ring having 1-4 heteroatoms independently selected from nitrogen, oxygen, and sulfur.

In some embodiments, $R^5$ is selected from

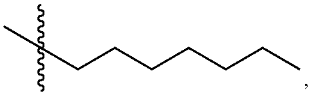, 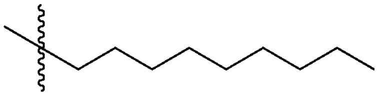,

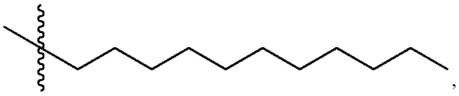, 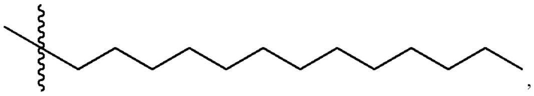,

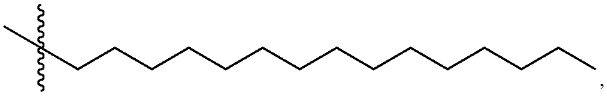,

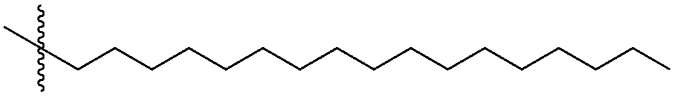,

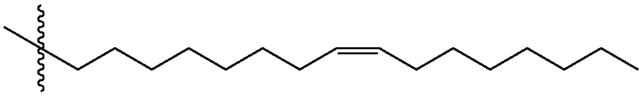,

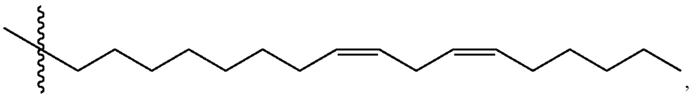,

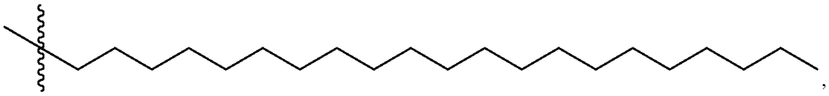,

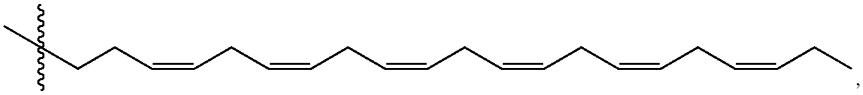,

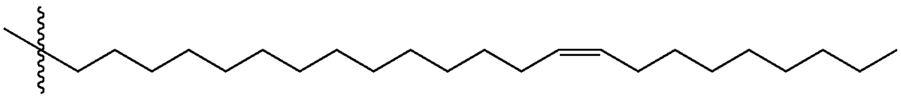,

-continued

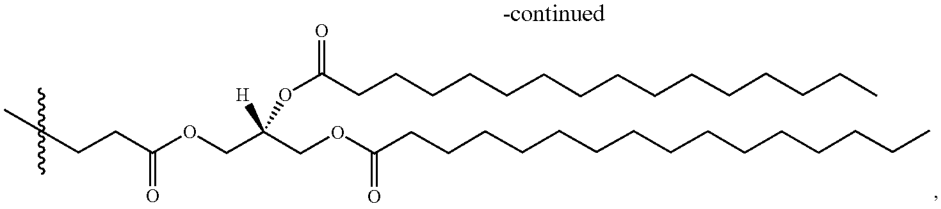

,

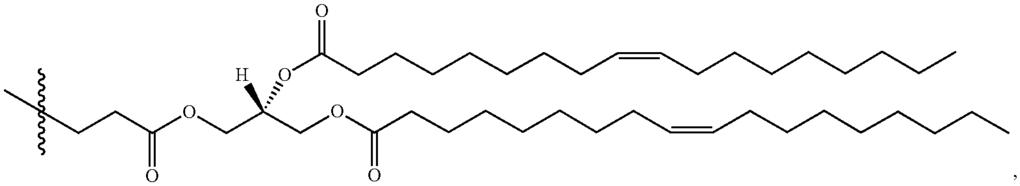

, and

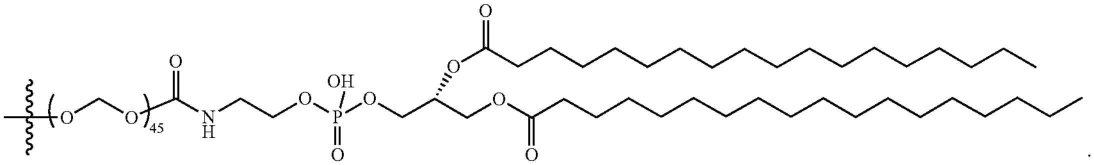

.

In some embodiments, $R^5$ is

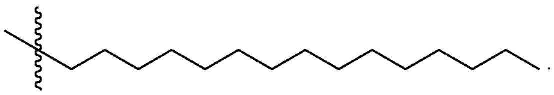 [SMILES: *CCCCCCCCCCCCCCC]

.

In some embodiments, $R^5$ is

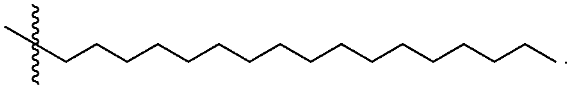 [SMILES: *CCCCCCCCCCCCCCCCC]

.

In some embodiments, the nucleotide sequence of the STAT3 targeting oligonucleotide comprises 1-10 targeting ligands. In some embodiments, the nucleotide sequence comprises 1, 2 or 3 targeting ligands.

In some embodiments, the STAT3 targeting oligonucleotide is a double-stranded molecule. In some embodiments, the STAT3 targeting oligonucleotide is an RNAi molecule.

In some embodiments, the STAT3 targeting oligonucleotide comprises a sense strand of 36 nucleotides with positions numbered 1-36 from 5' to 3'.

In some embodiments, the STAT3 targeting oligonucleotide comprises a lipid conjugated to the 5' terminal nucleotide of the sense strand. In some embodiments, the STAT3 targeting oligonucleotide comprises a C16 lipid conjugated to the 5' terminal nucleotide of the sense strand. In some embodiments, the STAT3 targeting oligonucleotide comprises a C18 lipid conjugated to the 5' terminal nucleotide of the sense strand.

In some embodiments, any STAT3 targeting oligonucleotide sequence described herein comprises a lipid conjugated to the 5' terminal nucleotide of the sense strand. In some embodiments, any STAT3 targeting oligonucleotide sequence described herein comprises C16 lipid conjugated to the 5' terminal nucleotide of the sense strand. In some embodiments, any STAT3 targeting oligonucleotide sequence described herein comprises C18 lipid conjugated to the 5' terminal nucleotide of the sense strand.

In some embodiments, the STAT3 targeting oligonucleotide comprises a lipid conjugated to the 5' terminal nucleotide of the sense strand, wherein the lipid is

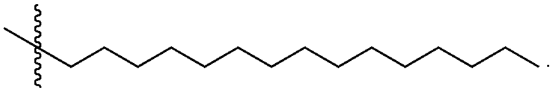 [SMILES: *CCCCCCCCCCCCCCC]

.

In some embodiments, the STAT3 targeting oligonucleotide comprises a lipid conjugated to the 5' terminal nucleotide of the sense strand, wherein the lipid is

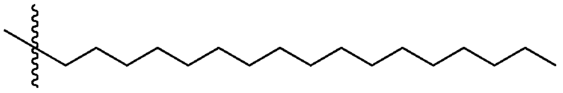

.

In some embodiments, a STAT3 targeting oligonucleotide comprises a sense strand comprising the sequence set forth in SEQ ID NO: 140 and an antisense strand comprising the sequence set forth in SEQ ID NO: 333, wherein the sense strand comprises a lipid conjugated to the 5' terminal nucleotide. In some embodiments, a STAT3 targeting oligonucleotide comprises a sense strand comprising the sequence set forth in SEQ ID NO: 140 and an antisense strand comprising the sequence set forth in SEQ ID NO: 333, wherein the sense strand comprises a C16 lipid conjugated to the 5' terminal nucleotide. In some embodiments, a STAT3 targeting oligonucleotide comprises a sense strand comprising the sequence set forth in SEQ ID NO: 140 and an antisense strand comprising the sequence set forth in SEQ ID NO: 333, wherein the sense strand comprises a C18 lipid conjugated to the 5' terminal nucleotide.

In some embodiments, a STAT3 targeting oligonucleotide comprises a sense strand comprising the sequence set forth in SEQ ID NO: 875 and an antisense strand comprising the sequence set forth in SEQ ID NO: 965, wherein the sense strand comprises a lipid conjugated to the 5' terminal nucleotide. In some embodiments, a STAT3 targeting oligonucleotide comprises a sense strand comprising the sequence set forth in SEQ ID NO: 875 and an antisense strand comprising the sequence set forth in SEQ ID NO: 965, wherein the sense strand comprises a C16 lipid conjugated to the 5' terminal nucleotide. In some embodiments, a STAT3 targeting oligonucleotide comprises a sense strand comprising the sequence set forth in SEQ ID NO: 875 and an antisense strand comprising the sequence set forth in SEQ ID NO: 965, wherein the sense strand comprises a C18 lipid conjugated to the 5' terminal nucleotide.

In some embodiments, a STAT3 targeting oligonucleotide comprises a sense strand comprising the sequence set forth in SEQ ID NO: 140 and an antisense strand comprising the sequence set forth in SEQ ID NO: 333, wherein the sense strand comprises a lipid conjugated to the 5' terminal nucleotide, wherein the lipid is

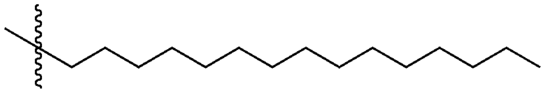.

In some embodiments, a STAT3 targeting oligonucleotide comprises a sense strand comprising the sequence set forth in SEQ ID NO: 140 and an antisense strand comprising the sequence set forth in SEQ ID NO: 333, wherein the sense strand comprises a lipid conjugated to the 5' terminal nucleotide, wherein the lipid is

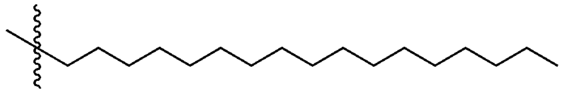.

In some embodiments, a STAT3 targeting oligonucleotide comprises a sense strand comprising the sequence set forth in SEQ ID NO: 875 and an antisense strand comprising the sequence set forth in SEQ ID NO: 965, wherein the sense strand comprises a lipid conjugated to the 5' terminal nucleotide, wherein the lipid is

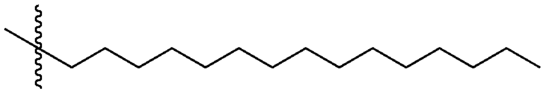.

In some embodiments, a STAT3 targeting oligonucleotide comprises a sense strand comprising the sequence set forth in SEQ ID NO: 875 and an antisense strand comprising the sequence set forth in SEQ ID NO: 965, wherein the sense strand comprises a lipid conjugated to the 5' terminal nucleotide, wherein the lipid is

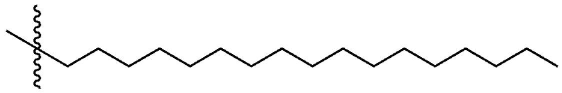.

In some embodiments, a STAT3 targeting oligonucleotide comprises an antisense strand of 15 to 30 nucleotides and a sense strand of 15 to 40 nucleotide, wherein the sense and antisense strands form a duplex region, wherein the antisense strand comprises a region of complementarity to a STAT3 mRNA target sequence expressed in an immune cell associated with a tumor microenvironment, wherein the sense strand comprises at its 3' end a stem-loop comprising a tetraloop comprising 4 nucleosides, wherein the 5' terminal nucleotide of the sense strand is represented by formula II-Ib:

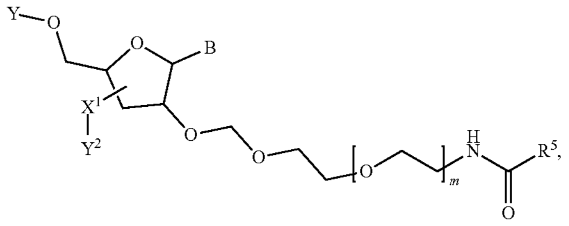

wherein B is selected from an adenine and a guanine nucleobase, and wherein $R^5$ is a hydrocarbon chain. In some embodiments, m is 1, X1 is O, Y2 is an internucleotide linking group attaching to the 5' terminal of a nucleoside, Y is represented by

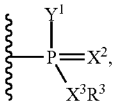

Y1 is a linking group attaching to the 2' or 3' terminal of a nucleotide, X2 is O, X3 is O, and R3 is H.

In some embodiments, the hydrocarbon chain is a C8-C30 hydrocarbon chain. In some embodiments, the hydrocarbon chain is a C16 hydrocarbon chain. In some embodiments, the C16 hydrocarbon chain is represented by

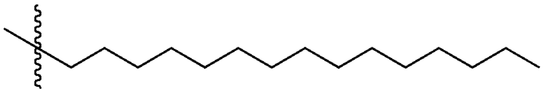.

In some embodiments, the hydrocarbon chain is a C18 hydrocarbon chain. In some embodiments, the C18 hydrocarbon chain is represented by

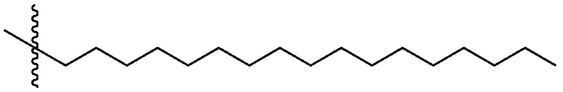.

In some embodiments, the oligonucleotide comprises a sense strand comprising a sequence of SEQ ID NO: 140, wherein the sense strand comprises a C18 lipid.

Exemplary STAT3 Targeting Oligonucleotides

In some embodiments, an oligonucleotide for reducing expression of STAT3 mRNA comprises a sense strand and an antisense strand described herein, wherein the sense and antisense strands are modified based on the pattern below

```
Sense Strand:
[ademXs-C18][mX][mX][mX][mX][mX][mX][fX][fX][fX]

[fX][mX][mX][mX][mX][mX][mX][mX][mX][mX][mX][mX]

[mX][mX][mX][mX][mX][mX][mX][mX][mX][mX][mX][mX]

[mX][mX]

Hybridized to

Antisense Strand:
[MePhosphonate-40-mXs][fXs][fXs][fX][fX][mX][fX]

[mX][mX][fX][mX][mX][mX][fX][mX][mX][mX][mX][mX]

[mXs][mXs][mX]
```

(key provided in Table 7).

In some embodiments, C# is C16 or C18.

In some embodiments, an oligonucleotide for reducing expression of STAT3 mRNA comprises a sense strand and an antisense strand described herein, wherein the sense and antisense strands are modified based on the pattern below

```
Sense Strand:
[ademXs-C#][mX][mX][mX][mX][mX][mX][fX][fX][fX]

[fX][mX][mX][mX][mX][mX][mX][mX][mX][mX][mX][mX]

[mX][mX][mX][mX][mX][mX][mX][mX][mX][mX][mX][mX]

[mX][mX]

Hybridized to

Antisense Strand:
[MePhosphonate-40-mXs][fXs][fXs][fX][fX][mX][fX]

[mX][mX][fX][mX][mX][mX][fX][mX][mX][mX][mX][mX]

[mXs][mXs][mX]
```

(key provided in Table 7).

In some embodiments, an oligonucleotide for reducing expression of STAT3 mRNA comprises a sense and antisense strand comprise SEQ ID NOs: 875 and 965, respectively.

wherein the sense and antisense strands are modified based on the pattern below

```
Sense Strand:
[ademXs-C18][mX][mX][mX][mX][mX][mX][fX][fX][fX]

[fX][mX][mX][mX][mX][mX][mX][mX][mX][mX][mX][mX]

[mX][mX][mX][mX][mX][mX][mX][mX][mX][mX][mX][mX]

[mX][mX]

Hybridized to

Antisense Strand:
[MePhosphonate-40-mXs][fXs][fXs][fX][fX][mX][fX]

[mX][mX][fX][mX][mX][mX][fX][mX][mX][m]X[mX][mX]

[mXs][mXs][mX]
```

(key provided in Table 7). In some embodiments, C# is C16 or C18.

In some embodiments, an oligonucleotide for reducing expression of STAT3 mRNA comprises a sense strand and an antisense strand comprising SEQ ID NOs: 875 and 965, respectively, wherein the sense and antisense strands are modified based on the pattern below

```
Sense Strand:
[ademXs-C#][mX][mX][mX][mX][mX][X][fX][fX][X][fX]

[mX][mX][X][mX][mX][mX][mX][mX][X][mX][mX][mX]

[mX][mX][mX][mX][mX][mX][mX][mX][mX][mX][X][mX]

[mX]

Hybridized to
Antisense Strand:
[MePhosphonate-40-mXs][fXs][fXs][fX][fX][mX][fX]]

[mX][mX][fX][mX][mX][mX][fX][mX][mX][mX][mX][mX]

[mXs][mXs][mX]
```

(key provided in Table 7).

In some embodiments, an oligonucleotide for reducing expression of STAT3 mRNA comprises a sense and antisense strand comprising SEQ ID NOs: 1222 and 1145, respectively.

In some embodiments, an oligonucleotide for reducing expression of STAT3 mRNA comprises a sense strand sequence of SEQ ID NO: 140. In some embodiments, an oligonucleotide for reducing expression of STAT3 mRNA comprises a sense strand sequence of SEQ ID NO: 875.

In some embodiments, an oligonucleotide for reducing expression of STAT3 mRNA comprises an antisense strand sequence of SEQ ID NO: 333. In some embodiments, an oligonucleotide for reducing expression of STAT3 mRNA comprises an antisense strand sequence of SEQ ID NO: 965.

In some embodiments, an oligonucleotide for reducing expression of STAT3 mRNA comprises a sense strand sequence of SEQ ID NO: 875 and an antisense strand selected of SEQ ID NO: 965.

In some embodiments, an oligonucleotide for reducing expression of STAT3 mRNA comprises a sense strand sequence of SEQ ID NO: 1222.

In some embodiments, an oligonucleotide for reducing expression of STAT3 mRNA comprises an antisense strand sequence of SEQ ID NO:1145.

In some embodiments, an oligonucleotide for reducing expression of STAT3 mRNA comprises a sense strand sequence of SEQ ID NOs: 1222 and an antisense strand sequence of SEQ ID NO: 1145.

In some embodiments, an oligonucleotide for reducing expression of STAT3 mRNA described herein comprises minimal off-target effects. For example, in some embodiments, an oligonucleotide described herein reduces STAT3 expression and does not reduce STAT1 expression or reduces STAT1 expression less than STAT3 expression. In some embodiments, the oligonucleotide comprises a sense strand comprising the nucleotide sequence set forth in SEQ ID NO: 875 and an antisense strand comprising the nucleotide sequence set forth in SEQ ID NO: 965, wherein the oligonucleotide reduces STAT3 expression and does not reduce STAT1 expression or reduces STAT1 expression less than STAT3 expression. In some embodiments, the oligonucleotide comprises a sense strand comprising the nucleotide sequence set forth in SEQ ID NO: 1222 and an antisense strand comprising the nucleotide sequence set forth in SEQ ID NO: 1145, wherein the oligonucleotide reduces STAT3 expression and does not reduce STAT1 expression or reduces STAT1 expression less than STAT3 expression.

In some embodiments, an oligonucleotide for reducing expression of STAT3 mRNA reduces STAT3 mRNA by at least 50%, at least 55%, at least 60%, at least 65%, at least 70%, at least 75%, at least 80%, at least 85%, at least 90%, or at least 95%.

In some embodiments, an oligonucleotide for reducing expression of STAT3 mRNA comprises the sense strand sequence of SEQ ID NO: 875 and the antisense strand sequence of SEQ ID NO: 965, wherein the oligonucleotide reduces STAT3 mRNA in humans.

In some embodiments, an oligonucleotide for reducing expression of STAT3 mRNA comprises the sense strand sequence of SEQ ID NO: 875 and the antisense strand sequence of SEQ ID NO: 965, wherein the oligonucleotide reduces STAT3 mRNA by at least 75%.

In some embodiments, an oligonucleotide for reducing expression of STAT3 mRNA comprises the sense strand sequence of SEQ ID NO: 875 and the antisense strand sequence of SEQ ID NO: 965, wherein the oligonucleotide is conjugated to a lipid on the 5' terminal nucleotide of the sense strand.

In some embodiments, an oligonucleotide for reducing expression of STAT3 mRNA comprises the sense strand sequence of SEQ ID NO: 875 and the antisense strand sequence of SEQ ID NO: 965, wherein the oligonucleotide is conjugated to a C18 lipid on the 5' terminal nucleotide of the sense strand.

In some embodiments, an oligonucleotide for reducing expression of STAT3 mRNA comprises the sense strand sequence of SEQ ID NO: 875 and the antisense strand sequence of SEQ ID NO: 965, wherein the oligonucleotide is conjugated to a lipid on the 5' terminal nucleotide of the sense strand and reduces STAT3 mRNA in humans.

In some embodiments, an oligonucleotide for reducing expression of STAT3 mRNA comprises the sense strand sequence of SEQ ID NO: 875 and the antisense strand sequence of SEQ ID NO: 965, wherein the oligonucleotide is conjugated to a lipid on the 5' terminal nucleotide of the sense strand and reduces STAT3 mRNA in humans by at least 75%.

In some embodiments, an oligonucleotide for reducing expression of STAT3 mRNA comprises the sense strand sequence of SEQ ID NO: 875 and the antisense strand sequence of SEQ ID NO: 965, wherein the oligonucleotide is conjugated to a C18 lipid on the 5' terminal nucleotide of the sense strand and reduces STAT3 mRNA in humans by at least 75%.

In some embodiments, an oligonucleotide for reducing expression of STAT3 mRNA comprises the sense strand sequence of SEQ ID NO: 1222 and the antisense strand sequence of SEQ ID NO: 1145, wherein the oligonucleotide reduces STAT3 mRNA in humans.

In some embodiments, an oligonucleotide for reducing expression of STAT3 mRNA comprises the sense strand sequence of SEQ ID NO: 1222 and the antisense strand sequence of SEQ ID NO: 1145, wherein the oligonucleotide reduces STAT3 mRNA by at least 75%.

Formulations

Various formulations have been developed to facilitate oligonucleotide use. For example, oligonucleotides can be delivered to a subject or a cellular environment using a formulation that minimizes degradation, facilitates delivery and/or uptake, or provides another beneficial property to the oligonucleotides in the formulation. In some embodiments, an oligonucleotide is formulated in buffer solutions such as phosphate buffered saline solutions, liposomes, micellar structures, and capsids.

Formulations of oligonucleotides with cationic lipids can be used to facilitate transfection of the oligonucleotides into cells. For example, cationic lipids, such as lipofectin, cationic glycerol derivatives, and polycationic molecules (e.g., polylysine, can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Accordingly, in some embodiments, a formulation comprises a lipid nanoparticle. In some embodiments, an excipient comprises a liposome, a lipid, a lipid complex, a microsphere, a microparticle, a nanosphere or a nanoparticle, or may be otherwise formulated for administration to the cells, tissues, organs, or body of a subject in need thereof (see, e.g., Remington: THE SCIENCE AND PRACTICE OF PHARMACY, 22nd edition, Pharmaceutical Press, 2013).

In some embodiments, the formulations herein comprise an excipient. In some embodiments, an excipient confers to a composition improved stability, improved absorption, improved solubility and/or therapeutic enhancement of the active ingredient. In some embodiments, an excipient is a buffering agent (e.g., sodium citrate, sodium phosphate, a tris base, or sodium hydroxide) or a vehicle (e.g., a buffered solution, petrolatum, dimethyl sulfoxide, or mineral oil). In some embodiments, an oligonucleotide is lyophilized for extending its shelf-life and then made into a solution before use (e.g., administration to a subject). Accordingly, an excipient in a composition comprising any one of the oligonucleotides described herein may be a lyoprotectant (e.g., mannitol, lactose, polyethylene glycol or polyvinylpyrrolidone) or a collapse temperature modifier (e.g., dextran, Ficoll™ or gelatin).

In some embodiments, a pharmaceutical composition is formulated to be compatible with its intended route of administration. Examples of routes of administration include parenteral (e.g., intravenous, intramuscular, intraperitoneal, intradermal, subcutaneous), oral (e.g., inhalation), transdermal (e.g., topical), transmucosal and rectal administration.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). The carrier can be a solvent or dispersion medium containing, for example, water, ethanol, polyol (e.g., glycerol, propylene glycol, and liquid polyethylene glycol, and the like), and suitable mixtures thereof. In many cases, it will be preferable to include isotonic agents, for example, sugars, polyalcohol's such as mannitol, sorbitol, sodium chloride in the composition. Sterile injectable solutions can be prepared by incorporating the oligonucleotides in a required amount in a selected solvent with one or a combination of ingredients enumerated above, as required, followed by filtered sterilization.

In some embodiments, a composition may contain at least about 0.1% of the therapeutic agent or more, although the percentage of the active ingredient(s) may be between about 1% to about 80% or more of the weight or volume of the total composition. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

Even though several embodiments are directed to liver-targeted delivery of any of the oligonucleotides herein, targeting of other tissues is also contemplated.

Programmed Death Ligand 1 (PD-L1) Inhibitors

In some embodiments, the disclosure provides a PD-L1 inhibitor for use in combination with an oligonucleotide described herein. In some embodiments, the PD-L1 inhibitor inhibits association of PD-L1 and PD-1. In some embodiments, the PD-L1 inhibitor is specific for PD-L1. In some embodiments, the PD-L1 inhibitor is an anti-PD-L1 antibody. In some embodiments, the PD-L1 inhibitor is specific for PD-1. In some embodiments, the PD-L1 inhibitor is an anti-PD-1 antibody. In some embodiments, the antibody is a full-length antibody. In some embodiments, the antibody is an antibody fragment. In some embodiments, the PD-L1 inhibitor is a small molecule.

In some embodiments, the anti-PD-L1 antibody is atezolizumab. In some embodiments, the anti-PD-L1 antibody is avelumab. In some embodiments, the anti-PD-L1 antibody is envafolimab. In some embodiments, the anti-PD-L1 antibody is durvalumab.

In some embodiments, the anti-PD-L1 antibody is any anti-PD-L1 antibody known in the art, including, but not limited to, the anti-PD-L1 antibodies disclosed in Akinleye & Rasool "Immune checkpoint inhibitors of PD-L1 as cancer therapeutics" *J. of Hematology & Oncology.* 12(92): 2019. In some embodiments, the anti-PD-L1 antibody is BMS-936559. In some embodiments, the anti-PD-L1 antibody is CK-301. In some embodiments, the anti-PD-L1 antibody is CS-1001. In some embodiments, the anti-PD-L1 antibody is SHR-1316. In some embodiments, the anti-PD-L1 antibody is BG-A333.

In some embodiments, the anti-PD-1 antibody is nivolumab. In some embodiments, the anti-PD-1 antibody is pembrolizumab. In some embodiments, the anti-PD-1 antibody is cemiplimab.

In some embodiments, the anti-PD-L1 antibody described herein binds to PD-L1 with an affinity of about 30 nM to about 100 nM. In some embodiments, the anti-PD-L1 antibody described herein binds to PD-L1 with an affinity of about 30 nM. In some embodiments, the anti-PD-L1 antibody described herein binds to PD-L1 with an affinity of about 40 nM. In some embodiments, the anti-PD-L1 antibody described herein binds to PD-L1 with an affinity of about 50 nM. In some embodiments, the anti-PD-L1 antibody described herein binds to PD-L1 with an affinity of about 60 nM. In some embodiments, the anti-PD-L1 antibody described herein binds to PD-L1 with an affinity of about 70 nM. In some embodiments, the anti-PD-L1 antibody described herein binds to PD-L1 with an affinity of about 80 nM. In some embodiments, the anti-PD-L1 antibody described herein binds to PD-L1 with an affinity of about 90 nM. In some embodiments, the anti-PD-L1 antibody described herein binds to PD-L1 with an affinity of about 100 nM.

In some embodiments, the anti-PD-1 antibody described herein binds to PD-1 with an affinity of about 30 nM to about 100 nM. In some embodiments, the anti-PD-1 antibody described herein binds to PD-1 with an affinity of about 30 nM. In some embodiments, the anti-PD-1 antibody described herein binds to PD-1 with an affinity of about 40 nM. In some embodiments, the anti-PD-1 antibody described herein binds to PD-1 with an affinity of about 50 nM. In some embodiments, the anti-PD-1 antibody described herein binds to PD-1 with an affinity of about 60 nM. In some embodiments, the anti-PD-1 antibody described herein binds to PD-1 with an affinity of about 70 nM. In some embodiments, the anti-PD-1 antibody described herein binds to PD-1 with an affinity of about 80 nM. In some embodiments, the anti-PD-1 antibody described herein binds to PD-1 with an affinity of about 90 nM. In some embodiments, the anti-PD-1 antibody described herein binds to PD-1 with an affinity of about 100 nM.

In some embodiments, the antibody is generated using display technologies. Display technologies used to generate antibody polypeptides include any of the display techniques (e.g., display library screening techniques). In some embodiments, synthetic antibodies are designed, selected, or optimized by screening target antigens using display technologies (e.g., phage display technologies). Phage display libraries may comprise millions to billions of phage vectors, each expressing unique antibody fragments on their viral coats. Such libraries may provide richly diverse resources that are used to select potentially hundreds of antibody fragments with diverse levels of affinity for one or more antigens of interest (McCafferty, et al., 1990. Nature. 348: 552-4; Edwards, B. M. et al., 2003. JMB. 334:103-18; Schofield, D. et al., 2007. Genome Biol. 8, R254 and Pershad, K. et al., 2010. Protein Engineering Design and Selection. 23:279-88; the contents of each of which are herein incorporated by reference in their entirety). Often, the antibody fragments present in such libraries comprise scFv antibody fragments, comprising a fusion protein of $V_H$ and $V_L$ antibody domains joined by a flexible linker. In some cases, scFvs may contain the same sequence with the exception of unique sequences encoding variable loops of the CDRs. In some cases, scFvs are expressed as fusion proteins, linked to viral coat proteins (e.g., the N-terminus of the viral pill coat protein). VL chains may be expressed separately for assembly with VH chains in the periplasm prior to complex incorporation into viral coats. Precipitated library members may be sequenced from the bound phage to obtain cDNA encoding desired scFvs. Antibody variable domains or CDRs from such sequences may be directly incorporated into antibody sequences for recombinant antibody production or mutated and utilized for further optimization through in vitro affinity maturation.

In some embodiments, the sequences of the polypeptides to be encoded in the viral genomes are produced using yeast surface display technology. In some embodiments, recombinant antibodies are developed by displaying the antibody fragment of interest as a fusion to on the surface of the yeast, where the protein interacts with proteins and small molecules in a solution. scFvs with affinity toward desired receptors may be isolated from the yeast surface using magnetic separation and flow cytometry. Several cycles of yeast surface display and isolation may be done to attain scFvs with desired properties through directed evolution.

Methods for determining the affinity of an antibody for its antigen are known in the art. An exemplary method for determining binding affinity employs surface plasmon resonance. Surface plasmon resonance is an optical phenomenon that allows for the analysis of realtime biospecific interactions by detection of alterations in protein concentrations within a biosensor matrix, for example using the BIAcore system (Pharmacia Biosensor AB, Uppsala, Sweden and Piscataway, N.J.). For further descriptions, see Jonsson, U., et al. (1993) Ann. Biol. Clin. 51:19-26; Jonsson, U., i (1991)

Biotechniques 11:620-627; Johnsson, B., et al. (1995) J. Mol. Recognit. 8:125-131; and Johnsson, B., et al. (1991) Anal. Biochem. 198:268-277.

Kits

In some embodiments, the disclosure provides a kit comprising a STAT3 oligonucleotide herein, and instructions for administering the STAT3 oligonucleotide to a subject. In some embodiments, the disclosure provides a kit comprising a STAT3 oligonucleotide herein, and instructions for administering the STAT3 oligonucleotide to a subject that has received or is receiving a PD-L1 inhibitor. In some embodiments, the kit comprises, in a suitable container, an oligonucleotide herein, one or more controls, and various buffers, reagents, enzymes and other standard ingredients well known in the art. In some embodiments, the container comprises at least one vial, well, test tube, flask, bottle, syringe, or other container means, into which the oligonucleotide is placed, and in some instances, suitably aliquoted. In some embodiments where an additional component is provided, the kit contains additional containers into which this component is placed. The kits can also include a means for containing the oligonucleotide and any other reagent in close confinement for commercial sale. Such containers may include injection or blow-molded plastic containers into which the desired vials are retained. Containers and/or kits can include labeling with instructions for use and/or warnings.

In some embodiments, a kit comprises a STAT3 oligonucleotide herein, and a pharmaceutically acceptable carrier, or a pharmaceutical composition comprising the oligonucleotide and instructions for treating or delaying progression of a disease, disorder or condition associated with STAT3 expression in a subject in need thereof. In some embodiments, a kit comprises a STAT3 oligonucleotide herein, and a pharmaceutically acceptable carrier, or a pharmaceutical composition comprising the oligonucleotide and instructions for treating or delaying progression of a disease, disorder or condition associated with STAT3 expression in a subject in need thereof, wherein the subject has received or is receiving a PD-L1 inhibitor. In some embodiments, a kit comprises a STAT3 oligonucleotide herein, and a pharmaceutically acceptable carrier, or a pharmaceutical composition comprising the oligonucleotide and instructions for treating or delaying progression of a cancer in a subject in need thereof. In some embodiments, a kit comprises a STAT3 oligonucleotide herein, and a pharmaceutically acceptable carrier, or a pharmaceutical composition comprising the oligonucleotide and instructions for treating or delaying progression of a cancer in a subject in need thereof, wherein the subject has received or is receiving a PD-L1 inhibitor.

In some embodiments, a kit comprises a PD-L1 inhibitor, and a pharmaceutically acceptable carrier, or a pharmaceutical composition comprising the oligonucleotide and instructions for treating or delaying progression of a disease, disorder or condition in a subject in need thereof, wherein the subject has received or is receiving a STAT3 oligonucleotide described herein. In some embodiments, a kit comprises a PD-L1 inhibitor, and a pharmaceutically acceptable carrier, or a pharmaceutical composition comprising the oligonucleotide and instructions for treating or delaying progression of a cancer in a subject in need thereof, wherein the subject has received or is receiving a STAT3 oligonucleotide described herein.

EXAMPLES

While the disclosure has been described with reference to the specific embodiments set forth in the following Examples, it should be understood by those skilled in the art that various changes may be made, and equivalents may be substituted without departing from the true spirit and scope of the disclosure. Further, the following Examples are offered by way of illustration and are not intended to limit the scope of the disclosure in any manner. In addition, modifications may be made to adapt to a situation, material, composition of matter, process, process step or steps, to the objective, spirit, and scope of the disclosure. All such modifications are intended to be within the scope of the disclosure. Standard techniques well known in the art or the techniques specifically described below were utilized.

Abbreviations

Ac: acetyl
AcOH: acetic acid
ACN: acetonitrile
Ad: adamantyl
AIBN: 2,2'-azo bisisobutyronitrile
Anhyd: anhydrous
Aq: aqueous
$B_2Pin_2$: bis (pinacolato)diboron-4,4,4',4',5,5,5',5'-octamethyl-2,2'-bi(1,3,2-dioxaborolane)
BINAP: 2,2'-bis(diphenylphosphino)-1,1'-binaphthyl
$BH_3$: Borane
Bn: benzyl
Boc: tert-butoxycarbonyl
$Boc_2O$: di-tert-butyl dicarbonate
BPO: benzoyl peroxide
BuOH: n-butanol
CDI: carbonyldiimidazole
COD: cyclooctadiene
d: days
DABCO: 1,4-diazobicyclo[2.2.2]octane
DAST: diethylaminosulfur trifluoride
dba: dibenzylideneacetone
DBU: 1,8-diazobicyclo[5.4.0]undec-7-ene
DCE: 1,2-dichloroethane
DCM: dichloromethane
DEA: diethylamine
DHP: dihydropyran
DIBAL-H: diisobutylaluminum hydride
DIPA: diisopropylamine
DIPEA or DIEA: N,N-diisopropylethylamine
DMA: N,N-dimethylacetamide
DME: 1,2-dimethoxyethane
DMAP: 4-dimethylaminopyridine
DMF: N,N-dimethylformamide
DMP: Dess-Martin periodinane
DMSO-dimethyl sulfoxide
DMTr: 4,4'-dimethyoxytrityl
DPPA: diphenylphosphoryl azide
dppf: 1,1'-bis(diphenylphosphino) ferrocene
EDC or EDCI: 1-(3-dimethylaminopropyl)-3-ethylcarbodiimide hydrochloride
ee: enantiomeric excess ESI: electrospray ionization
EA: ethyl acetate
EtOAc: ethyl acetate
EtOH: ethanol
FA: formic acid
h or hrs: hours
HATU: N,N,N',N'-tetramethyl-O-(7-azabenzotriazol-1-yl)uronium
hexafluorophosphate
HCl: hydrochloric acid
HPLC: high performance liquid chromatography
HOAc: acetic acid
IBX: 2-iodoxybenzoic acid
IPA: isopropyl alcohol
KHMDS: potassium hexamethyldisilazide
$K_2CO_3$: potassium carbonate
LAH: lithium aluminum hydride
LDA: lithium diisopropylamide
L-DBTA: dibenzoyl-L-tartaric acid
m-CPBA: meta-chloroperbenzoic acid
M: molar
MeCN: acetonitrile
MeOH: methanol
$Me_2S$: dimethyl sulfide
MeONa: sodium methylate
MeI: iodomethane
min: minutes
mL: milliliters
mM: millimolar
mmol: millimoles
MPa: mega pascal
MOMCl: methyl chloromethyl ether
MsCl: methanesulfonyl chloride
MTBE: methyl tert-butyl ether
nBuLi: n-butyllithium
$NaNO_2$: sodium nitrite
NaOH: sodium hydroxide
$Na_2SO_4$: sodium sulfate
NBS: N-bromosuccinimide
NCS: N-chlorosuccinimide
NFSI: N-Fluorobenzenesulfonimide
NMO: N-methylmorpholine N-oxide
NMP: N-methylpyrrolidine
NMR: Nuclear Magnetic Resonance
° C.: degrees Celsius
Pd/C: Palladium on Carbon
$Pd(OAc)_2$: Palladium Acetate
PBS: phosphate buffered saline
PE: petroleum ether
$POCl_3$: phosphorus oxychloride
$PPh_3$: triphenylphosphine
PyBOP: (Benzotriazol-1-yloxy)tripyrrolidinophosphonium hexafluorophosphate
Rel: relative
R.T. or rt: room temperature
s or sec: second
sat: saturated
SEMCl: chloromethyl-2-trimethylsilylethyl ether
SFC: supercritical fluid chromatography
$SOCl_2$: sulfur dichloride
tBuOK: potassium tert-butoxide
TBAB: tetrabutylammonium bromide
TBAF: tetrabutylammmonium fluoride
TBAI: tetrabutylammonium iodide
TEA: triethylamine
Tf: trifluoromethanesulfonate
TfAA, TFMSA or $Tf_2O$: trifluoromethanesulfonic anhydride
TFA: trifluoroacetic acid
TIBSCl: 2,4,6-triisopropylbenzenesulfonyl chloride
TIPS: triisopropylsilyl
THF: tetrahydrofuran
THP: tetrahydropyran
TLC: thin layer chromatography
TMEDA: tetramethylethylenediamine
pTSA: para-toluenesulfonic acid
UPLC: Ultra Performance Liquid Chromatography
wt: weight
Xantphos: 4,5-bis(diphenylphosphino)-9,9-dimethylxanthene

Example 1: Preparation of Double-Stranded RNAi Oligonucleotides

General Synthetic Methods

The following examples are intended to illustrate the disclosure and are not to be construed as being limitations thereon. Temperatures are given in degrees centigrade (C). If not mentioned otherwise, all evaporations are performed under reduced pressure, preferably between about 15 mm Hg and 100 mm Hg (=20-133 mbar). The structure of final products, intermediates and starting materials was confirmed by standard analytical methods, e.g., microanalysis and spectroscopic characteristics, e.g., MS, IR, NMR. Abbreviations used are those conventional in the art.

All starting materials, building blocks, reagents, acids, bases, dehydrating agents, solvents, and catalysts utilized to synthesis the nucleic acid or analogues thereof of the present disclosure are either commercially available or can be produced by organic synthesis methods known to one of ordinary skill in the art (Methods of Organic Synthesis, Thieme, Volume 21 (Houben-Weyl 4th Ed. 1952)). Further, the nucleic acid or analogues thereof of the present disclosure can be produced by organic synthesis methods known to one of ordinary skill in the art as shown in the following examples.

All reactions are carried out under nitrogen or argon unless otherwise stated.

Proton NMR ($^1H$ NMR) was conducted in deuterated solvent. In certain nucleic acid or analogues thereof disclosed herein, one or more 1H shifts overlap with residual proteo solvent signals; these signals have not been reported in the experimental provided hereinafter. As depicted in the Examples below, in certain exemplary embodiments, the nucleic acid or analogues thereof were prepared according to the following general procedures. It will be appreciated that, although the general methods depict the synthesis of certain nucleic acid or analogues thereof of the present disclosure, the following general methods, and other methods known to one of ordinary skill in the art, can be applied to all nucleic acid or analogues thereof and subclasses and species of each of these nucleic acid or analogues thereof, as described herein.

Example 1a: Synthesis of 2-(2-((((6aR,8R,9R,9aR)-8-(6-benzamido-9H-purin-9-yl)-2,2,4,4-tetraisopropyltetrahydro-6H-furo[3,2-f][1,3,5,2,4]trioxadisilocin-9-yl)oxy)methoxy)ethoxy) ethan-1-ammonium Formate (1-6)
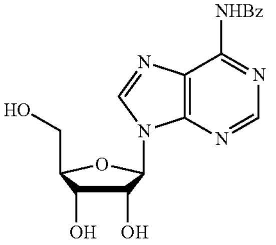
1-1
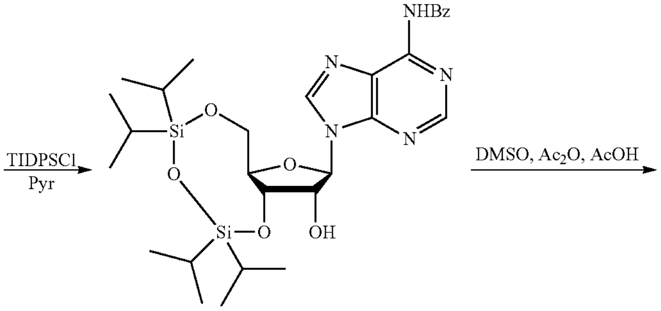
1-2
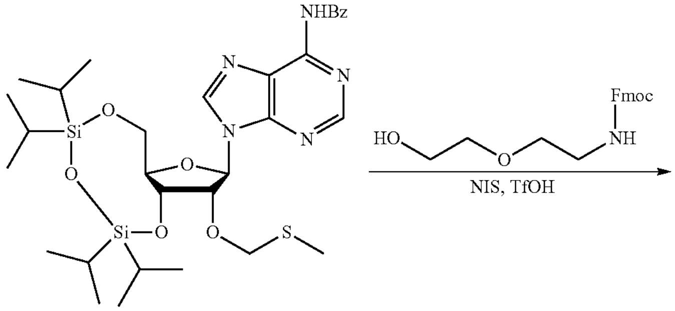
1-3
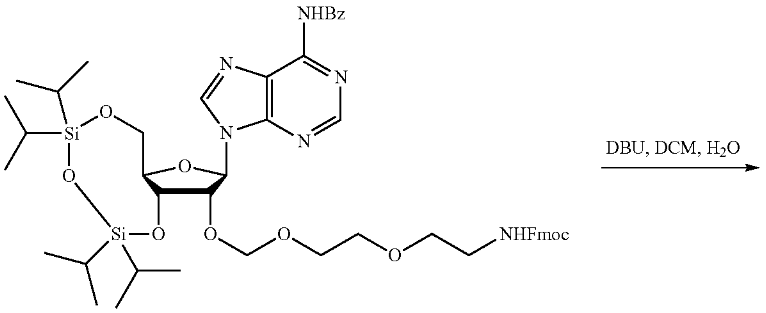
1-4
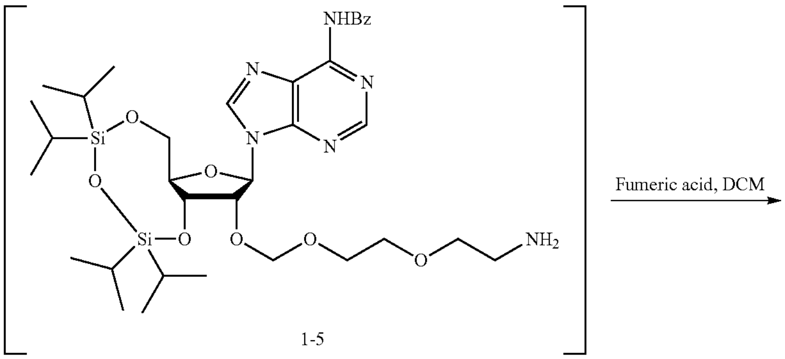
1-5

-continued

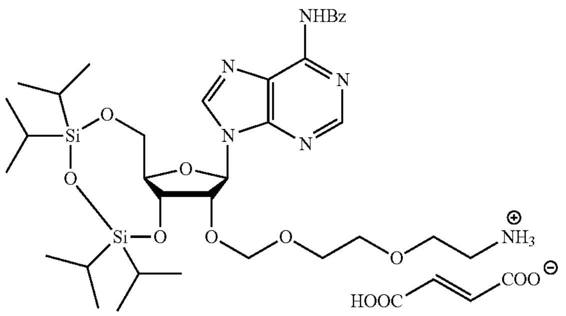

1-6

A solution of compound 1-1 (25.00 g, 67.38 mmol) in 20 mL of DMF was treated with pyridine (11 mL, 134.67 mmol) and tetraisopropyldisiloxane dichloride (22.63 mL, 70.75 mmol) at 10° C. The resulting mixture was stirred at 25° C. for 3 h and quenched with 20% citric acid (50 mL). The aqueous layer was extracted with EtOAc (3×50 mL) and the combined organic layers were concentrated in vacuo. The crude residue was recrystallized from a mixture of MTBE and n-heptane (1:15, 320 mL) to afford compound 1-2 (37.20 g, 90%) as a white oily solid.

A solution of compound 1-2 (37.00 g, 60.33 mmol) in 20 mL of DMSO was treated with AcOH (20 mL, 317.20 mmol) and $Ac_2O$ (15 mL, 156.68 mmol). The mixture was stirred at 25° C. for 15 h. The reaction was diluted with EtOAc (100 mL) and quenched with sat. $K_2CO_3$ (50 mL). The aqueous layer was extracted with EtOAc (3×50 mL). The combined organic layers were concentrated and recrystallized with ACN (30 mL) to afford compound 1-3 (15.65 g, 38.4%) as a white solid.

A solution of compound 1-3 (20.00 g, 29.72 mmol) in 120 mL of DCM was treated with Fmoc-amino-ethoxy ethanol (11.67 g, 35.66 mmol) at 25° C. The mixture was stirred to afford a clear solution and then treated with 4 Å molecular sieves (20.0 g), N-iodosuccinimide (8.02 g, 35.66 mmol), and TfOH (5.25 mL, 59.44 mmol). The mixture was stirred at 30° C. until the HPLC analysis indicated >95% consumption of compound 1-3. The reaction was quenched with TEA (6 mL) and filtered. The filtrate was diluted with EtOAc, washed with sat. $NaHCO_3$ (2×100 mL), sat. $Na_2SO_3$ (2×100 mL), and water (2×100 mL) and concentrated in vacuo to afford crude compound 1-4 (26.34 g, 93.9%) as a yellow solid, which was used directly for the next step without further purification.

A solution of compound 1-4 (26.34 g, 27.62 mmol) in a mixture of DCM/water (10:7, 170 mL) was treated with DBU (7.00 mL, 45.08 mmol) at 5° C. The mixture was stirred at 5-25° C. for 1 h. The organic layer was then separated, washed with water (100 mL), and diluted with DCM (130 mL). The solution was treated with fumaric acid (7.05 g, 60.76 mmol) and 4 Å molecular sieves (26.34 g) in four portions. The mixture was stirred for 1 h, concentrated, and recrystallized from a mixture of MTBE and DCM (5:1) to afford compound 1-6 (14.74 g, 62.9%) as a white solid: $^1$H NMR (400 MHz, $d_6$-DMSO) 8.73 (s, 1H), 8.58 (s, 1H), 8.15-8.02 (m, 2H), 7.65-7.60 (m, 1H), 7.59-7.51 (m, 2H), 6.52 (s, 2H), 6.15 (s, 1H), 5.08-4.90 (m, 3H), 4.83-4.78 (m, 1H), 4.15-3.90 (m, 3H), 3.79-3.65 (m, 2H), 2.98-2.85 (m, 6H), 1.20-0.95 (m, 28H).

Example 1b: Synthesis of (2R,3R,4R,5R)-5-(6-benzamido-9H-purin-9-yl)-2-((bis(4-methoxyphenyl)(phenyl)methoxy)methyl)-4-((2-(2-[lipid]-amidoethoxy)ethoxy)methoxy) tetrahydrofuran-3-yl(2-cyanoethyl) diisopropylphosphoramidite (2-4a to 2-4e)

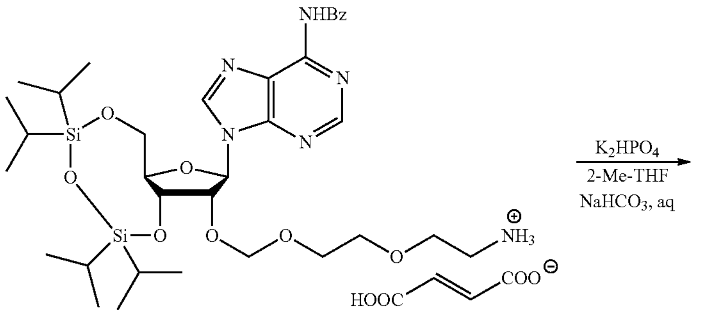

1-6

-continued
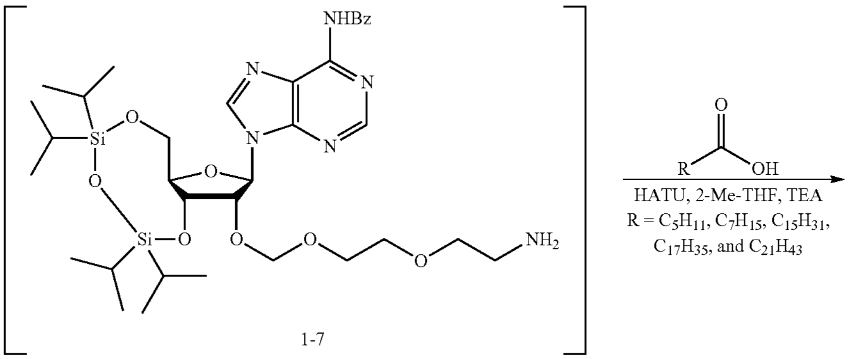
1-7
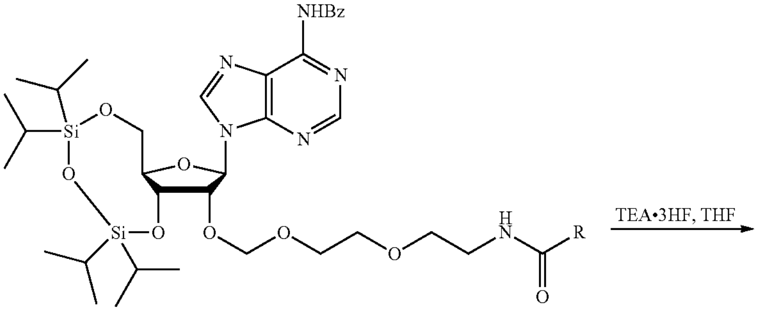
2-1a, R = $C_5H_{11}$
2-1b, R = $C_7H_{15}$
2-1c, R = $C_{15}H_{31}$
2-1d, R = $C_{17}H_{35}$
2-1e, R = $C_{21}H_{43}$
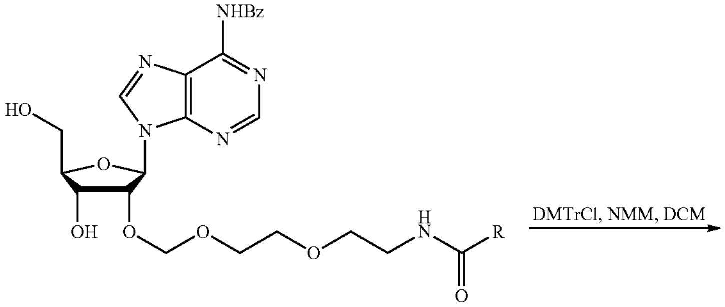
2-2a, R = $C_5H_{11}$
2-2b, R = $C_7H_{15}$
2-2c, R = $C_{15}H_{31}$
2-2d, R = $C_{17}H_{35}$
2-2e, R = $C_{21}H_{43}$
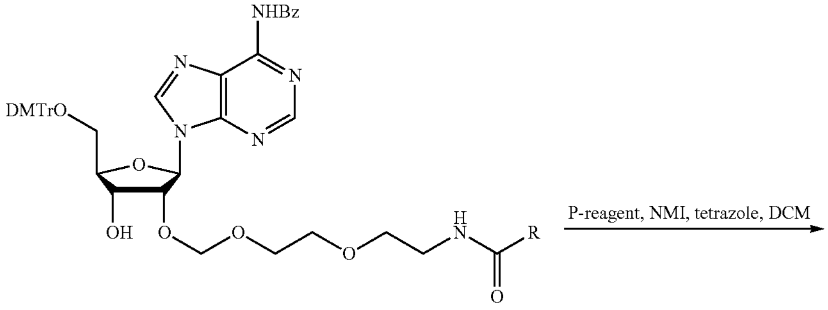
2-3a, R = $C_5H_{11}$
2-3b, R = $C_7H_{15}$
2-3c, R = $C_{15}H_{31}$
2-3d, R = $C_{17}H_{35}$
2-3e, R = $C_{21}H_{43}$ -continued

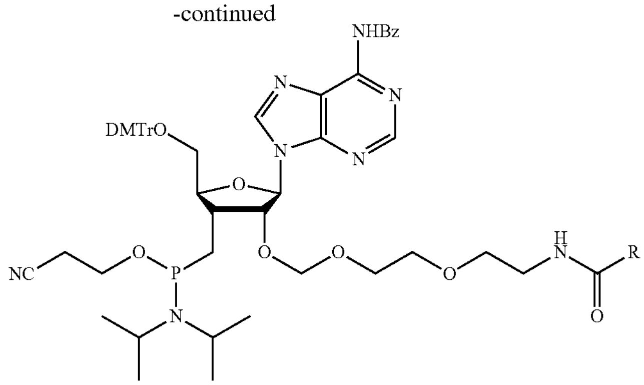

2-4a, R = $C_5H_{11}$
2-4b, R = $C_7H_{15}$
2-4c, R = $C_{15}H_{31}$
2-4d, R = $C_{17}H_{35}$
2-4e, R = $C_{21}H_{43}$

A solution of compound 1-6 (50.00 g, 59.01 mmol) in 150 mL of 2-methyltetrahydrofuran was washed with ice cold aqueous $K_2HPO_4$ (6%, 100 mL) and brine (20%, 2×100 mL). The organic layer was separated and treated with hexanoic acid (10.33 mL, 82.61 mmol), HATU (33.66 g, 88.52 mmol), and DMAP (10.81 g, 147.52 mmol) at 0° C. The resulting mixture was warmed to 25° C. and stirred for 1 h. The solution was washed with water (2×100 mL), brine (100 mL), and concentrated in vacuo to afford a crude residue. Flash chromatography on silica gel (1:1 hexanes/acetone) gave compound 2-1a (34.95 g, 71.5%) as a white solid.

A mixture of compound 2-1a (34.95 g, 42.19 mmol) and TEA (9.28 mL, 126.58 mmol) in 80 mL of THF was treated with triethylamine trihydrofluoride (20.61 mL, 126.58 mmol) dropwise at 10° C. The mixture was warmed to 25° C. and stirred for 2 h. The reaction was concentrated, dissolved in DCM (100 mL), and washed with sat. $NaHCO_3$ (5×20 mL) and brine (50 mL). The organic layer was concentrated in vacuo to afford crude compound 2-2a (24.72 g, 99%), which was used directly for the next step without further purification. A solution of compound 2-2a (24.72 g, 42.18 mmol) in 50 mL of DCM was treated with N-methylmorpholine (18.54 mL, 168.67 mmol) and DMTr-Cl (15.69 g, 46.38 mmol). The mixture was stirred at 25° C. for 2 h and quenched with sat. $NaHCO_3$ (50 mL). The organic layer was separated, washed with water, concentrated to afford a slurry crude. Flash chromatography on silica gel (1:1 hexanes/acetone) gave compound 2-3a (30.05 g, 33.8 mmol, 79.9%) as a white solid.

A solution of compound 2-3a (25.00 g, 28.17 mmol) in 50 mL of DCM was treated with N-methylmorpholine (3.10 mL, 28.17 mmol) and tetrazole (0.67 mL, 14.09 mmol) under nitrogen atmosphere. Bis (diisopropylamino) chlorophosphine (9.02 g, 33.80 mmol) was added to the solution dropwise and the resulting mixture was stirred at 25° C. for 4 h. The reaction was quenched with water (15 mL), and the aqueous layer was extracted with DCM (3×50 mL). The combined organic layers were washed with sat. $NaHCO_3$ (50 mL), concentrated to afford a crude solid that was recrystallized from a mixture of DCM/MTBE/n-hexane (1:4:40) to afford compound 2-4a (25.52 g, 83.4%) as a white solid: $^1H$ NMR (400 MHz, $d_6$-DMSO) 11.25 (s, 1H), 8.65-8.60 (m, 2H), 8.09-8.02 (m, 2H), 7.71 (s, 1H), 7.67-7.60 (m, 1H), 7.59-7.51 (m, 2H), 7.38-7.34 (m, 2H), 7.30-7.25 (m, 7H), 6.85-6.79 (m, 4H), 6.23-6.20 (m, 1H), 5.23-5.14 (m, 1H), 4.80-4.69 (m, 3H), 4.33-4.23 (m, 2H), 3.90-3.78 (m, 1H), 3.75 (s, 6H), 3.74-3.52 (m, 3H), 3.50-3.20 (m, 6H), 3.14-3.09 (m, 2H), 3.09 (s, 1H), 2.82-2.80 (m, 1H), 2.65-2.60 (m, 1H), 2.05-1.96 (m, 2H), 1.50-1.39 (m, 2H), 1.31-1.10 (m, 14H), 1.08-1.05 (m, 2H), 0.85-0.79 (m, 3H); $^{31}P$ NMR (162 MHz, $d_6$-DMSO) 149.43, 149.18.

Compound 2-4b, 2-4c, 2-4d, and 2-4e were prepared using similar procedures described above for compound 2-4a. Compound 2-4b was obtained (25.50 g, 85.4%) as a white solid: $^1H$ NMR (400 MHz, $d_6$-DMSO) 11.23 (s, 1H), 8.65-8.60 (m, 2H), 8.05-8.02 (m, 2H), 7.73-7.70 (m, 1H), 7.67-7.60 (m, 1H), 7.59-7.51 (m, 2H), 7.38-7.34 (m, 2H), 7.30-7.25 (m, 7H), 6.89-6.80 (m, 4H), 6.21-6.15 (m, 1H), 5.23-5.17 (m, 1H), 4.80-4.69 (m, 3H), 4.40-4.21 (m, 2H), 3.91-3.80 (m, 1H), 3.74 (s, 6H), 3.74-3.52 (m, 3H), 3.50-3.20 (m, 6H), 3.14-3.09 (m, 2H), 3.09 (s, 1H), 2.83-2.79 (m, 1H), 2.68-2.62 (m, 1H), 2.05-1.97 (m, 2H), 1.50-1.38 (m, 2H), 1.31-1.10 (m, 18H), 1.08-1.05 (m, 2H), 0.85-0.78 (m, 3H); $^{31}P$ NMR (162 MHz, $d_6$-DMSO) 149.43, 149.19.

Compound 2-4c was obtained (36.60 g, 66.3%) as an off-white solid: $^1H$ NMR (400 MHz, $d_6$-DMSO) 11.22 (s, 1H), 8.64-8.59 (m, 2H), 8.05-8.00 (m, 2H), 7.73-7.70 (m, 1H), 7.67-7.60 (m, 1H), 7.59-7.51 (m, 2H), 7.38-7.34 (m, 2H), 7.30-7.25 (m, 7H), 6.89-6.80 (m, 4H), 6.21-6.15 (m, 1H), 5.25-5.17 (m, 1H), 4.80-4.69 (m, 3H), 4.40-4.21 (m, 2H), 3.91-3.80 (m, 1H), 3.74 (s, 6H), 3.74-3.50 (m, 3H), 3.50-3.20 (m, 6H), 3.14-3.09 (m, 2H), 3.09 (s, 1H), 2.83-2.79 (m, 1H), 2.68-2.62 (m, 1H), 2.05-1.99 (m, 2H), 1.50-1.38 (m, 2H), 1.33-1.12 (m, 38H), 1.08-1.05 (m, 2H), 0.86-0.80 (m, 3H); $^{31}P$ NMR (162 MHz, $d_6$-DMSO) 149.42, 149.17.

Compound 2-4d was obtained (26.60 g, 72.9%) as an off-white solid: $^1H$ NMR (400 MHz, $d_6$-DMSO) 11.22 (s, 1H), 8.64-8.59 (m, 2H), 8.05-8.00 (m, 2H), 7.73-7.70 (m, 1H), 7.67-7.60 (m, 1H), 7.59-7.51 (m, 2H), 7.38-7.33 (m, 2H), 7.30-7.25 (m, 7H), 6.89-6.80 (m, 4H), 6.21-6.15 (m, 1H), 5.22-5.17 (m, 1H), 4.80-4.69 (m, 3H), 4.40-4.21 (m, 2H), 3.91-3.80 (m, 1H), 3.74 (s, 6H), 3.74-3.52 (m, 3H), 3.50-3.20 (m, 6H), 3.14-3.09 (m, 2H), 3.09 (s, 1H), 2.83-2.79 (m, 1H), 2.68-2.62 (m, 1H), 2.05-1.99 (m, 2H), 1.50-1.38 (m, 2H), 1.35-1.08 (m, 38H), 1.08-1.05 (m, 2H), 0.85-0.79 (m, 3H); $^{31}P$ NMR (162 MHz, $d_6$-DMSO) 149.47, 149.22.

Compound 2-4e was obtained (38.10 g, 54.0%) as a white solid: $^{1}H$ NMR (400 MHz, $d_6$-DMSO) 11.21 (s, 1H), 8.64-8.59 (m, 2H), 8.05-8.00 (m, 2H), 7.73-7.70 (m, 1H), 7.67-7.60 (m, 1H), 7.59-7.51 (m, 2H), 7.38-7.34 (m, 2H), 7.30-7.25 (m, 7H), 6.89-6.80 (m, 4H), 6.21-6.15 (m, 1H), 5.23-5.17 (m, 1H), 4.80-4.69 (m, 3H), 4.40-4.21 (m, 2H), 3.91-3.80 (m, 1H), 3.73 (s, 6H), 3.74-3.52 (m, 3H), 3.47-3.22 (m, 6H), 3.14-3.09 (m, 2H), 3.09 (s, 1H), 2.83-2.79 (m, 1H), 2.68-2.62 (m, 1H), 2.05-1.99 (m, 2H), 1.50-1.38 (m, 2H), 1.35-1.06 (m, 46H), 1.08-1.06 (m, 2H), 0.85-0.77 (m, 3H); $^{31}P$ NMR (162 MHz, $d_6$-DMSO) 149.41, 149.15.

Example 2. Synthesis of GalXC RNAi Oligonucleotide-Lipid Conjugates

Scheme 1. Synthesis of GalXC RNAi oligonucleotide-lipid conjugates with mono-lipid (linear and branched) conjugated to the tetraloop. Post-synthetic conjugation was realized through amide coupling reactions.
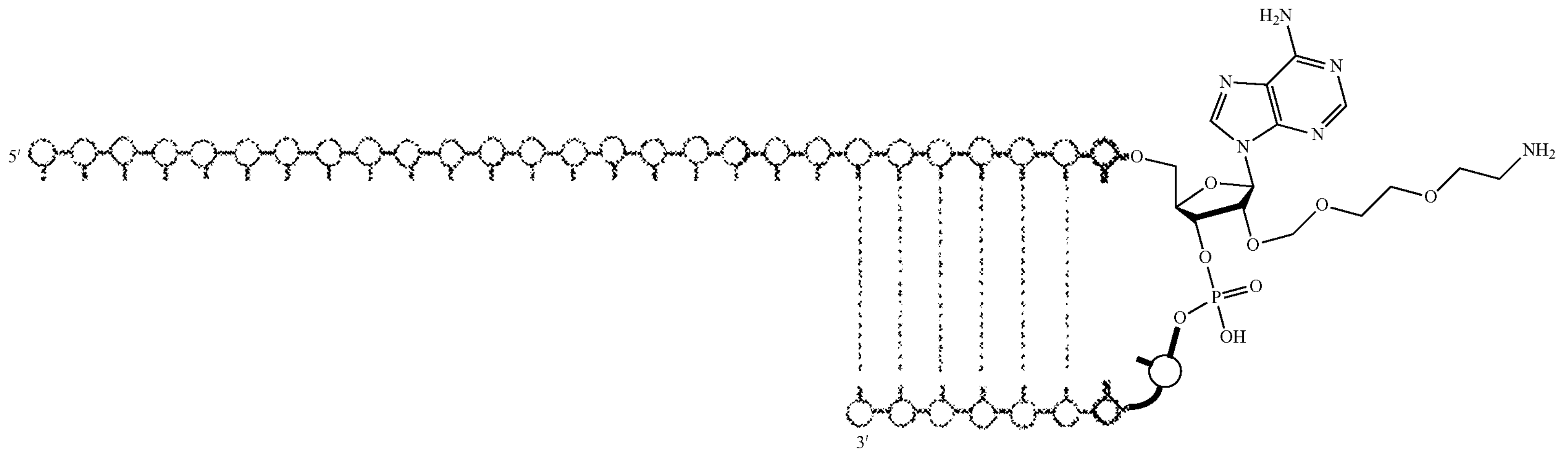
Sense 1
Lipid, $R_1COOH$ -continued
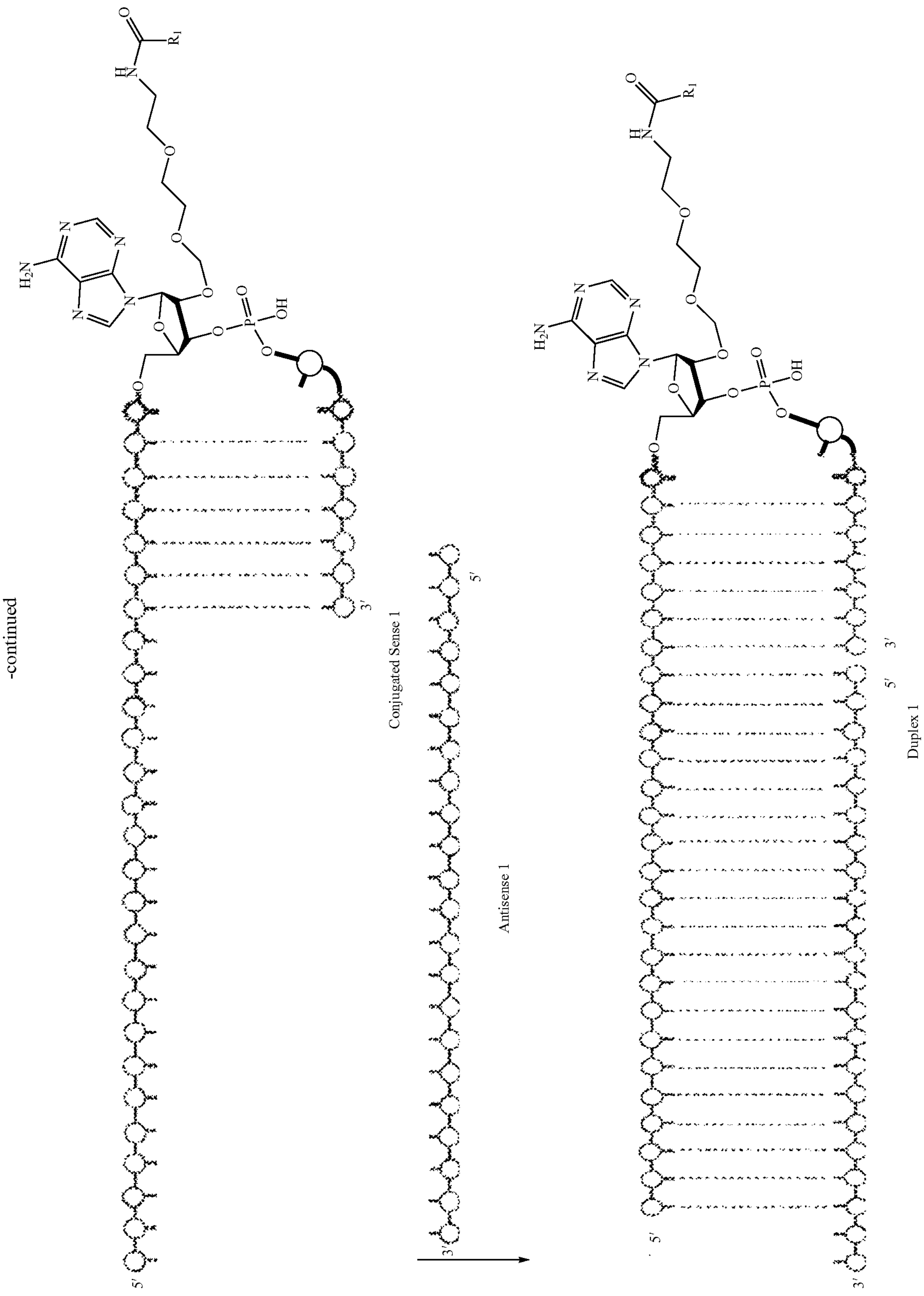

$R_1COOH$ group represents fatty acid C8:0, C10:0, C11:0, C12:0, C14:0, C16:0, C17:0, C18:0, C18:1, C18:2, C22:5, C22:0, C24:0, C26:0, C22:6, C24:1, diacyl C16:0 or diacyl C18:1
Duplex 1a
$R_1$ = 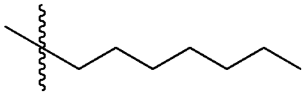 ,
(C8)
Duplex 1b
$R_1$ = 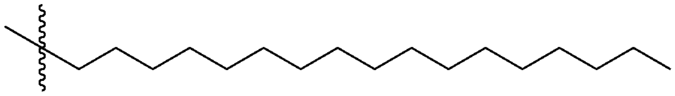 ,
(C18)
Duplex 1c
$R_1$ = 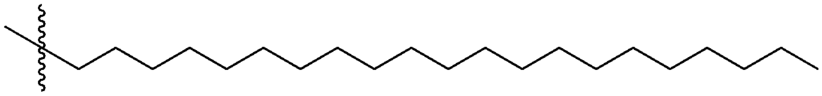 ,
(C22)
Duplex 1d
$R_1$ = 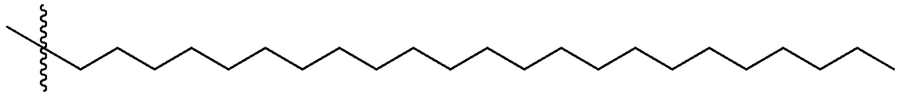 ,
(C24)
Duplex 1e
$R_1$ = 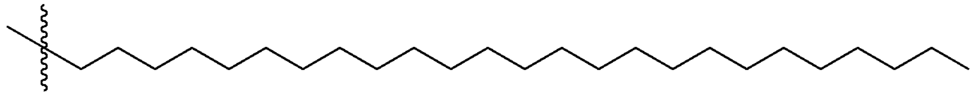 ,
(C26)
Duplex 1f
$R_1$ = 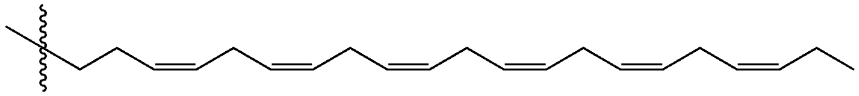 ,
(C22:6)
Duplex 1g
$R_1$ = 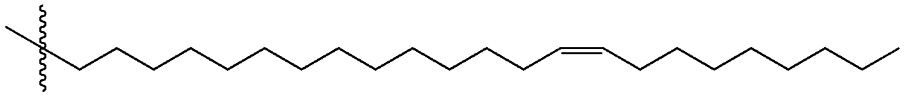 ,
(C24:1)
Duplex 1h
$R_1$ = 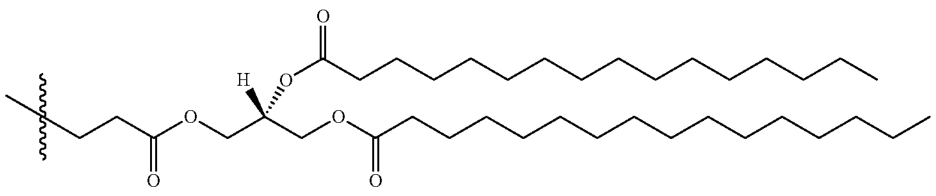 ,
(diacyl C16)
Duplex 1i
R = 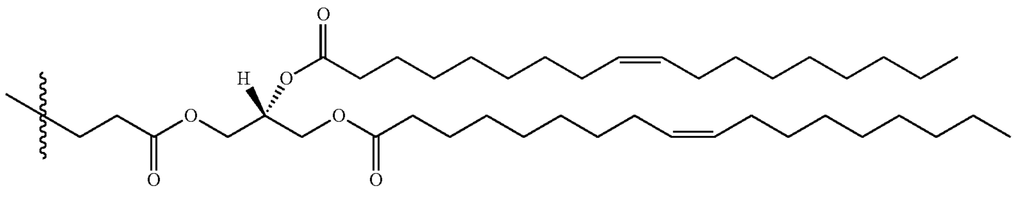 ,
(diacyl C18:1)

Synthesis Sense 1 and Antisense 1 were Prepared by Solid-Phase Synthesis.

Synthesis of Conjugated Sense 1a-1i.

Conjugated Sense 1a was synthesized through post-syntenic conjugation approach. In Eppendorf tube 1, a solution of octanoic acid (0.58 mg, 4 umol) in DMA (0.75 mL) was treated with HATU (1.52 mg, 4 umol) at rt. In Eppendorf tube 2, a solution of oligo Sense 1 (10.00 mg, 0.8 umol) in $H_2O$ (0.25 mL) was treated with DIPEA (1.39 uL, 8 umol). The solution in Eppendorf tube 1 was added to the Eppendorf tube 2 and mixed using Thermomixer at rt. After the reaction was completed indicated by LC-MS analysis, the reaction mixture was diluted with 5 mL of water and purified by revers phase XBridge C18 column using a 5-95% gradient of 100 mM TEAA in ACN and $H_2O$. The product fractions were concentrated under reduced pressure using Genevac. The combined residual solvent was dialyzed against water (1×), saline (1×), and water (3×) using Amicon® Ultra-15 Centrifugal (3K). The Amicon membrane was washed with water (3×2 mL) and the combined solvents were then lyophilized to afford an amorphous white solid of Conjugated Sense 1a (6.43 mg, 64% yield).

Conjugated Sense 1b-1i were prepared using similar procedures as described for the synthesis of Conjugated Sense 1a and obtained in 42%-69% yields.

Annealing of Duplex 1a-1j.

Conjugated Sense 1a (10 mg, measured by weight) was dissolved in 0.5 mL deionized water to prepare a 20 mg/mL solution. Antisense 1 (10 mg, measured by OD) was dissolved in 0.5 mL deionized water to prepare a 20 mg/mL solution, which was used for the titration of the conjugated sense and quantification of the duplex amount. Based on the calculation of molar amounts of both conjugated sense and antisense, a proportion of required Antisense 1 was added to the Conjugated Sense 1a solution. The resulting mixture was stirred at 95° C. for 5 min and allowed to cool down to rt. The annealing progress was monitored by ion-exchange HPLC. Based on the annealing progress, several proportions of Antisense 1 were further added to complete the annealing with >95% purity. The solution was lyophilized to afford Duplex 1a (C8) and its amount was calculated based on the molar amount of the antisense consumed in the annealing.

Duplex 1b-1i were prepared using the same procedures as described for the annealing of Duplex 1a (C8).

The following Scheme 1-2 depicts the synthesis of Nicked tetraloop GalXC conjugates with mono-lipid on the loop. Post-synthetic conjugation was realized through Cu-catalyzed alkyne-azide cycloaddition reaction.

Scheme 1-2
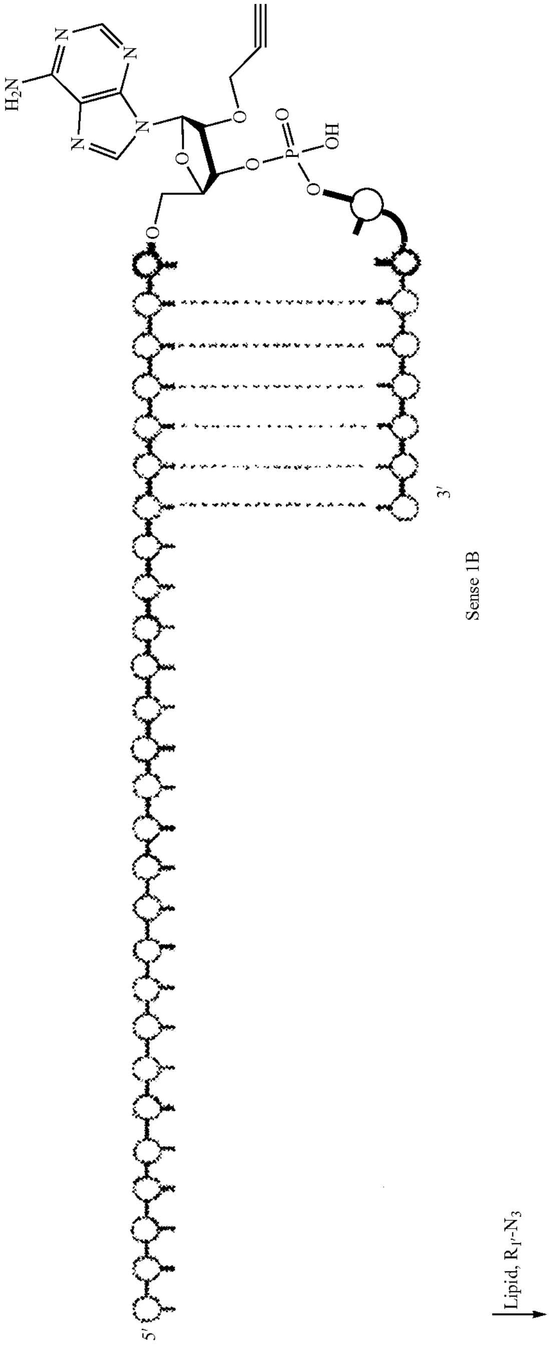
Sense 1B

-continued
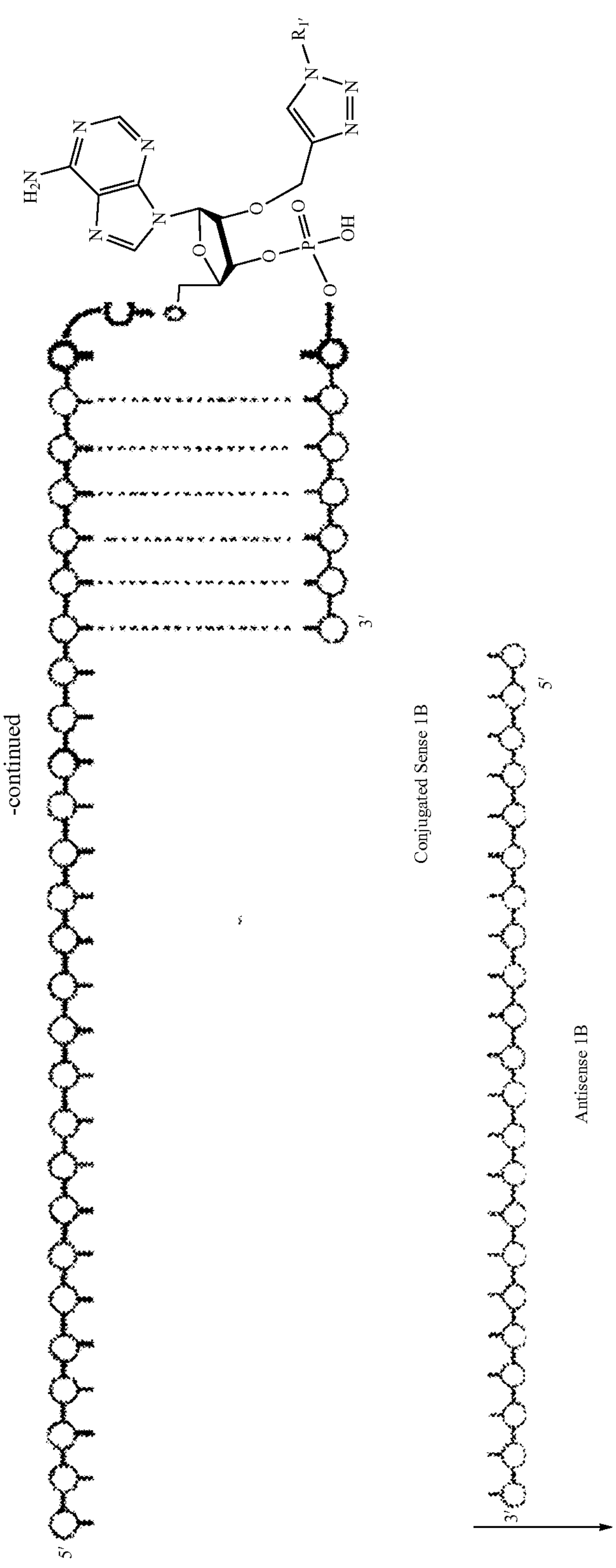
Conjugated Sense 1B
Antisense 1B

-continued
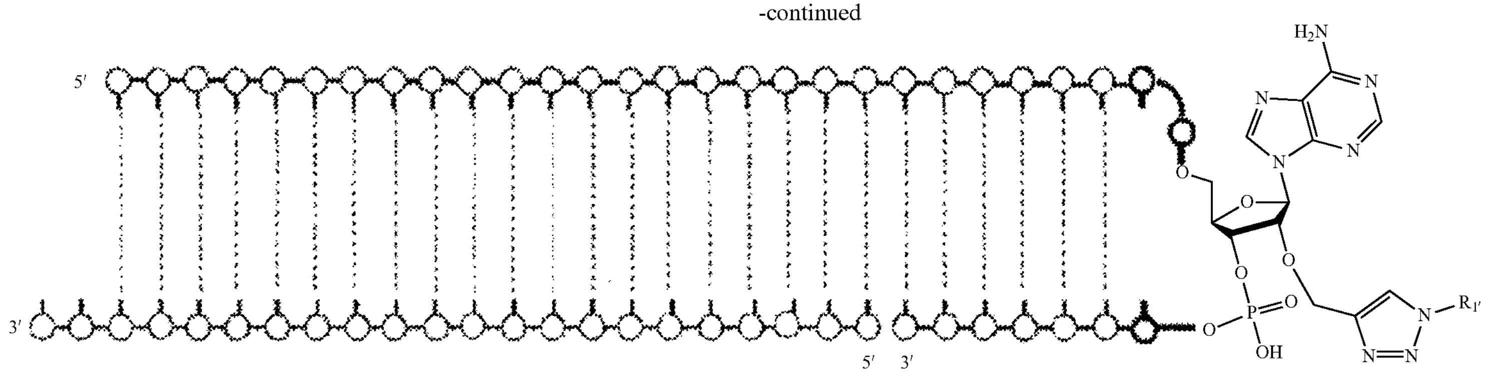
Duplex 1j
Duplex 1j (PEG2K-diacyl C18), $R_{1'}$ =
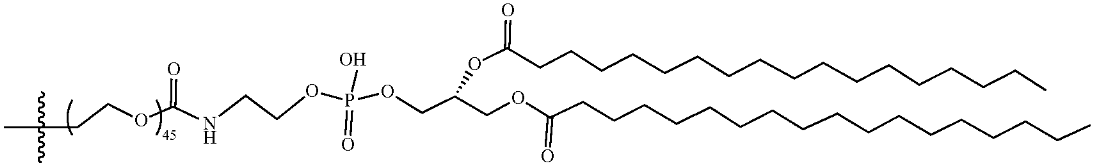

Sense 1B and Antisense 1B were Prepared by Solid-Phase Synthesis.

Synthesis of Conjugated Sense 1j.

In Eppendorf tube 1, a solution of oligo (10.00 mg, 0.8 μmol) in a 3:1 mixture of DMA/$H_2O$ (0.5 mL) was treated with the lipid linker azide (11.26 mg, 4 μmol). In Eppendorf tube 2, CuBr dimethyl sulfide (1.64 mg, 8 μmol) was dissolved in ACN (0.5 mL). Both solutions were degassed for 10 min by bubbling $N_2$ through them. The ACN solution of $CuBrSMe_2$ was then added into tube 1 and the resulting mixture was stirred at 40° C. After the reaction was completed indicated by LC-MS analysis, the reaction mixture was diluted with 0.5 M EDTA (2 mL) and dialyzed against water (2×) using a Amicon® Ultra-15 Centrifugal (3K). The reaction crude was purified by revers phase XBridge C18 column using a 5-95% gradient of 100 mM TEAA in ACN (with 30% IPA spiked in) and $H_2O$. The product fractions were concentrated under reduced pressure using Genevac. The combined residual solvent was dialyzed against water (1×), saline (1×), and water (3×) using Amicon® Ultra-15 Centrifugal (3K). The Amicon membrane was washed with water (3×2 mL) and the combined solvents were lyophilized to afford an amorphous white solid of Conjugated Sense 1j (6.90 mg, 57% yield).

Duplex 1j (PEG2K-diacyl C18) was prepared using the same procedures as described for the annealing of Duplex 1a (C8).

The following Scheme 1-3 depicts the synthesis of Nicked tetraloop GalXC conjugates with di-lipid on the loop using post-synthetic conjugation approach.

Scheme 1-3
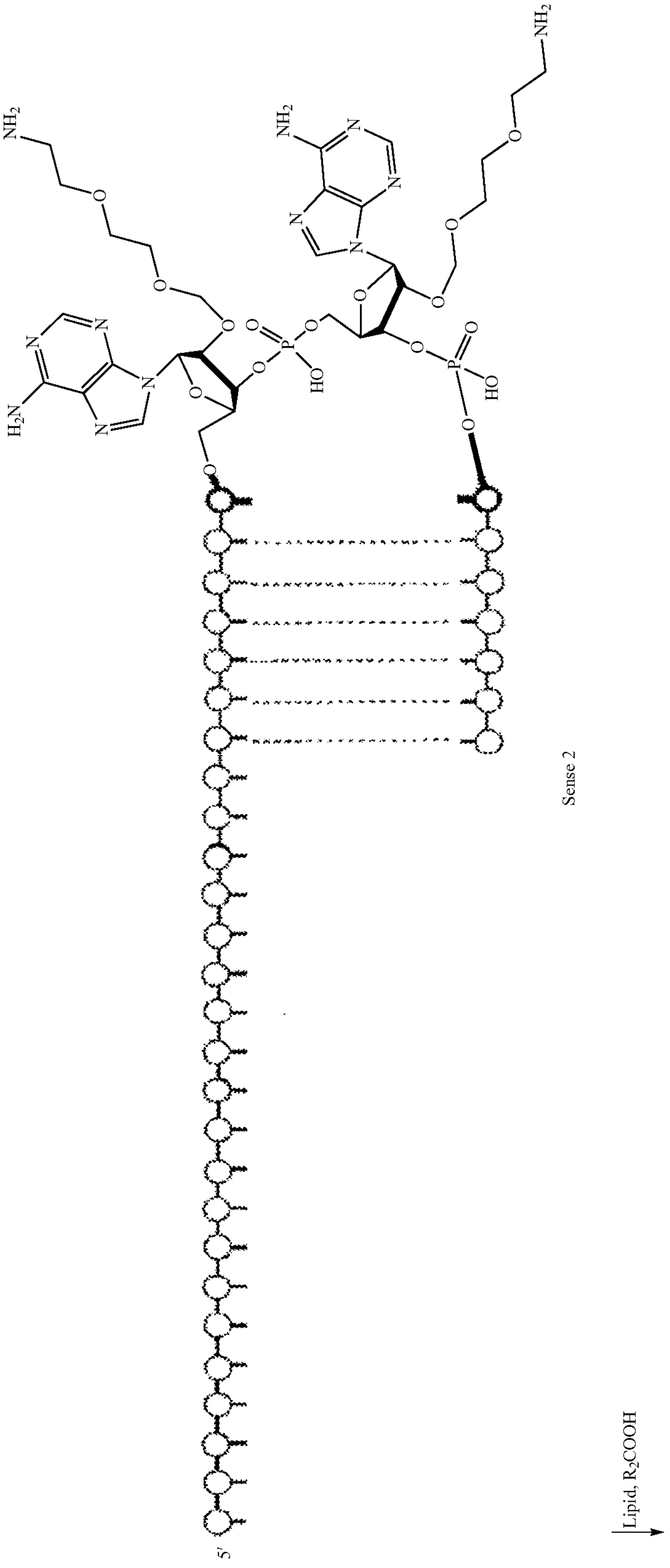

-continued
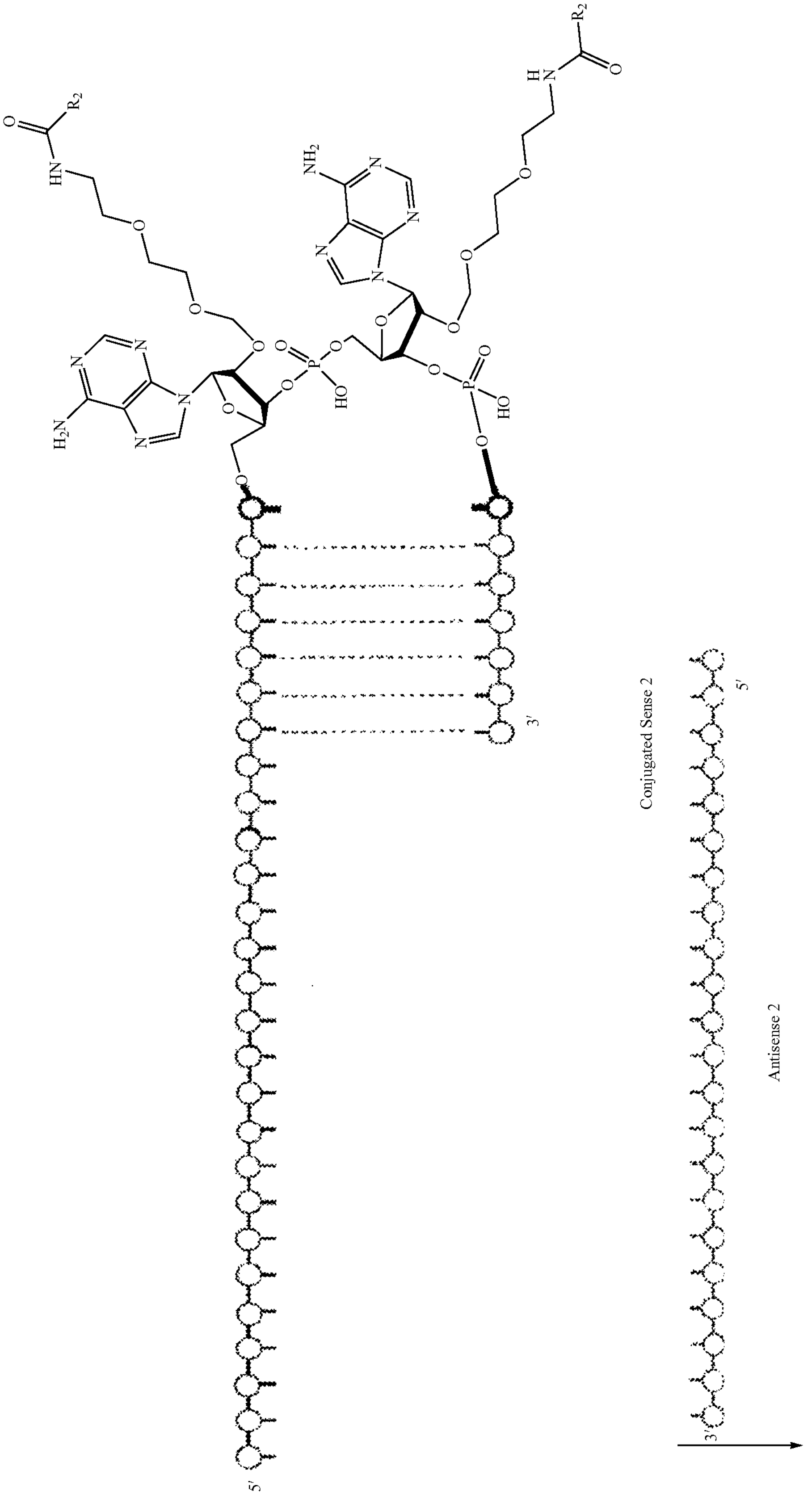
Conjugated Sense 2
Antisense 2

-continued
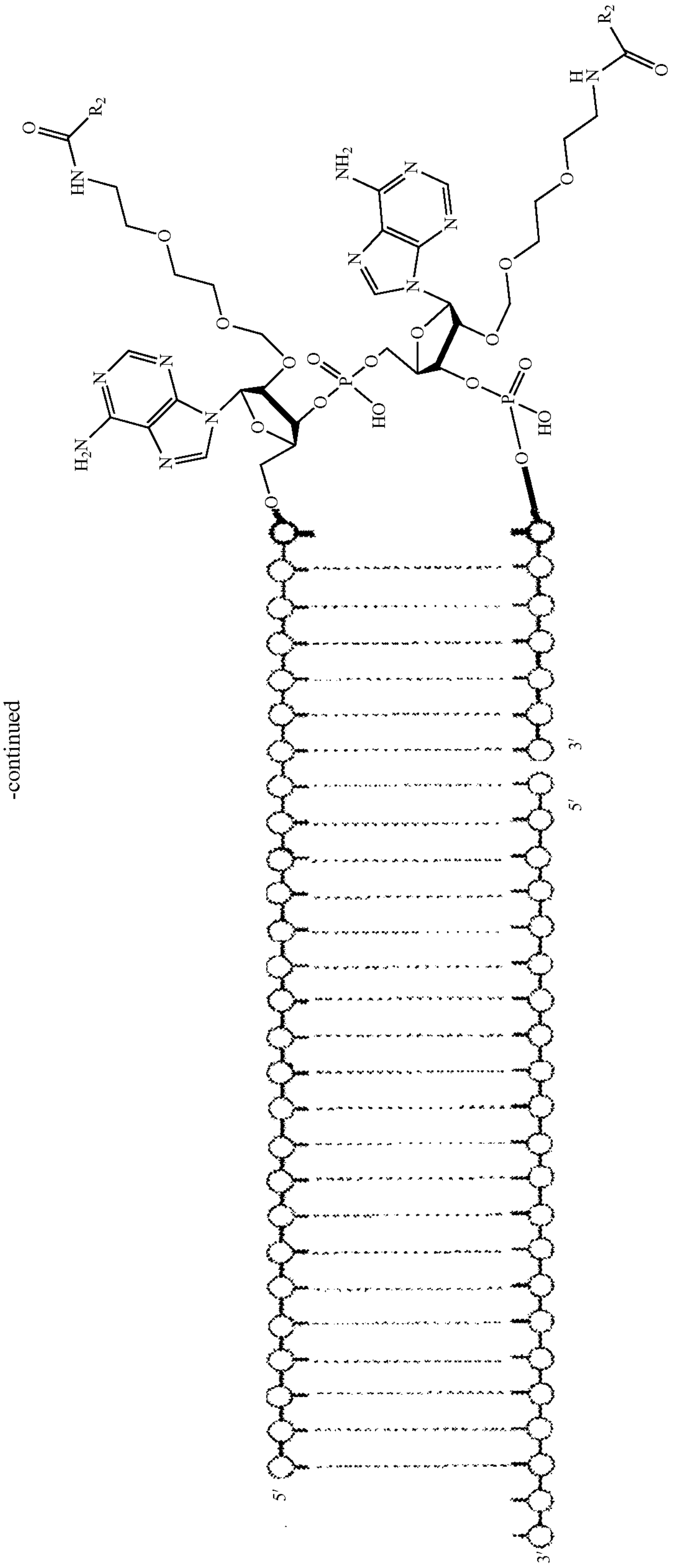
Duplex 2
Duplex 2a (2XC11), $R_2$ =
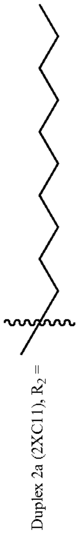
Duplex 2b (2XC22), $R_2$ =
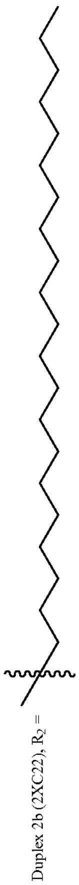

Sense 2 and Antisense 2 were Prepared by Solid-Phase Synthesis.

Conjugated Sense 2a and 2b were prepared using similar procedures as described for the synthesis of Conjugated Sense 1a but with 10 eq of lipid, 10 eq of HATU, and 20 eq of DIPEA.

Duplex 2a (2×C11) and 2b (2×C22) were prepared using the same procedures as described for the annealing of Duplex 1a (C8).

The following Scheme 1-4 depicts the synthesis of GalXC of fully phosphorothioated stem-loop conjugated with mono-lipid using post-synthetic conjugation approach.

Scheme 1-4
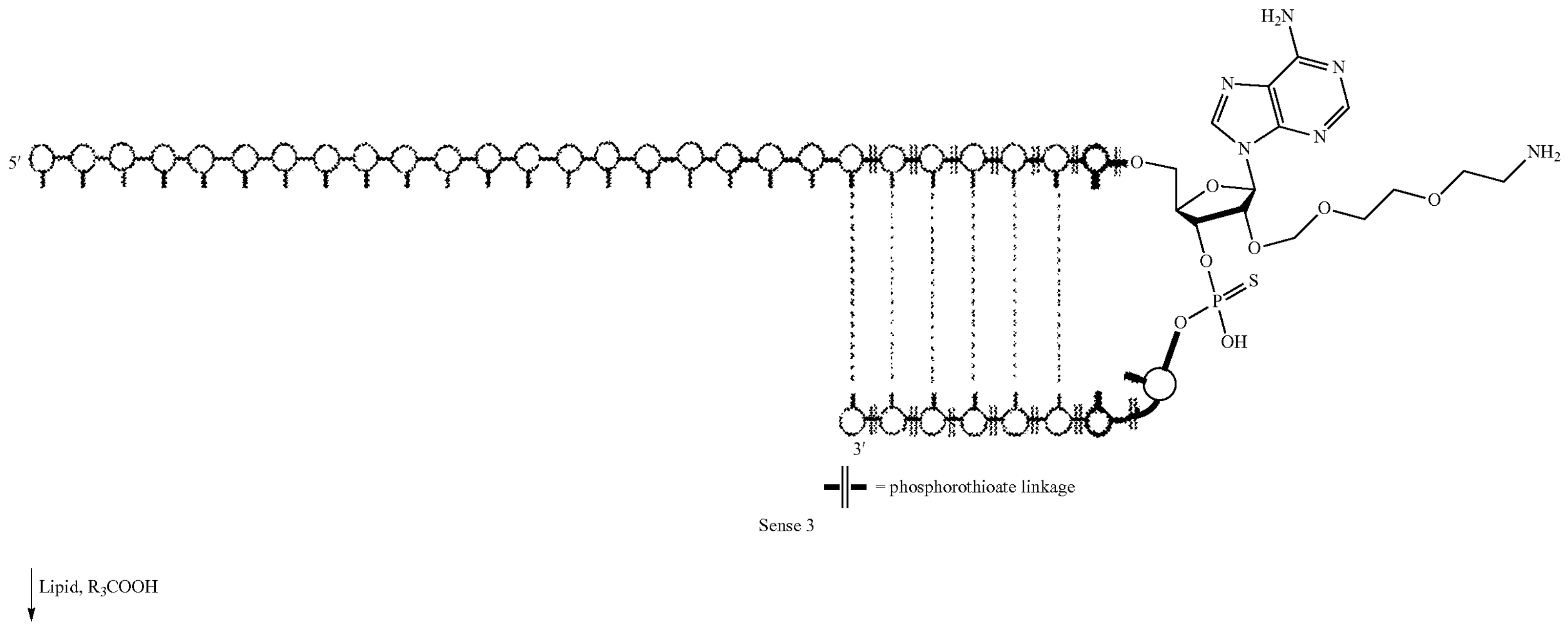

-continued
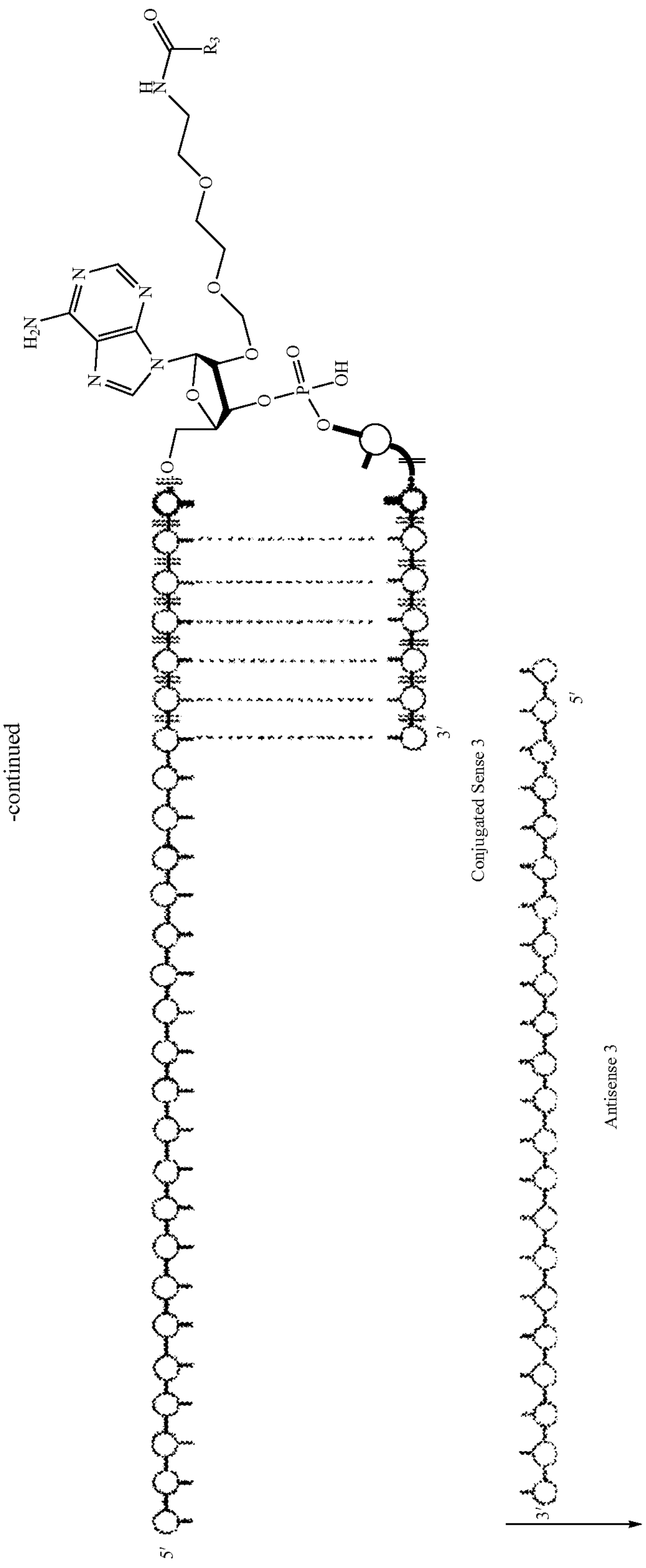
Conjugated Sense 3
Antisense 3

-continued
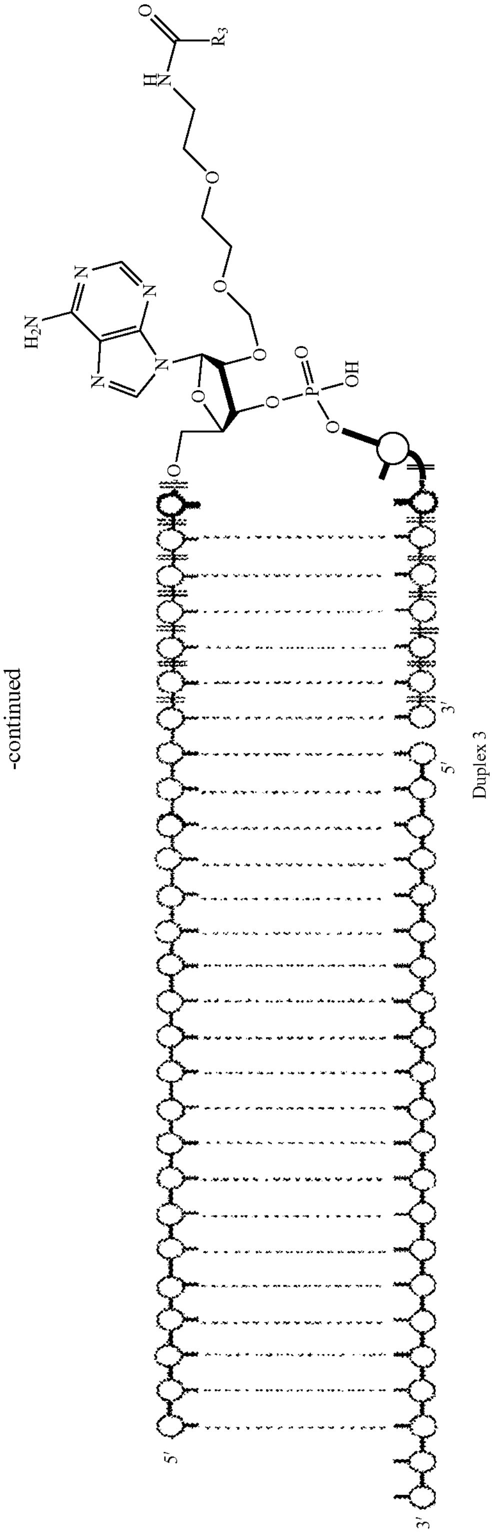
Duplex 3
Duplex 3a (PS-C22), $R_3$ =
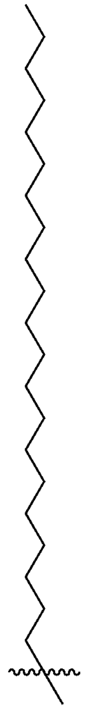

Sense 3 and Antisense 3 were Prepared by Solid-Phase Synthesis.

Conjugated Sense 3a was prepared using similar procedures as described for the synthesis of Conjugated Sense 1a and obtained in a 65% yield.

Duplex 3a (PS-C22) was prepared using the same procedures as described for the annealing of Duplex 1a (C8).

The following Scheme 1-5 depicts the synthesis of GalXC of short sense conjugated with mono-lipid using post-synthetic conjugation approach.

Scheme 1-5
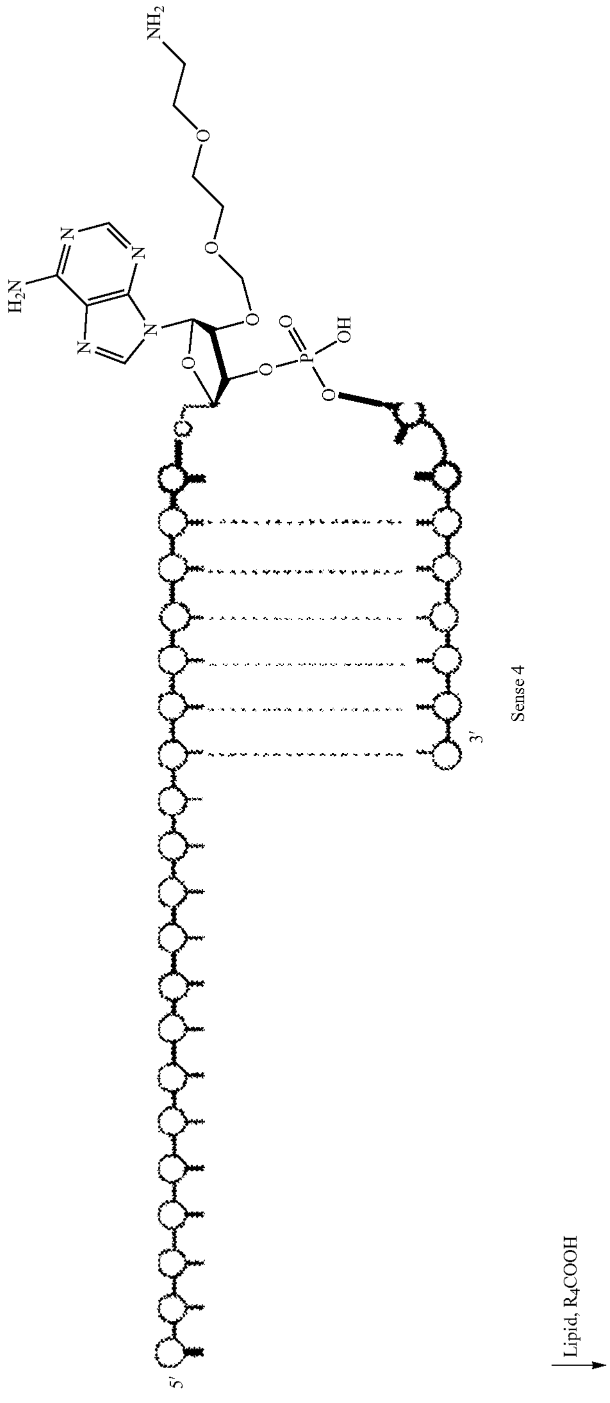
Sense 4

-continued
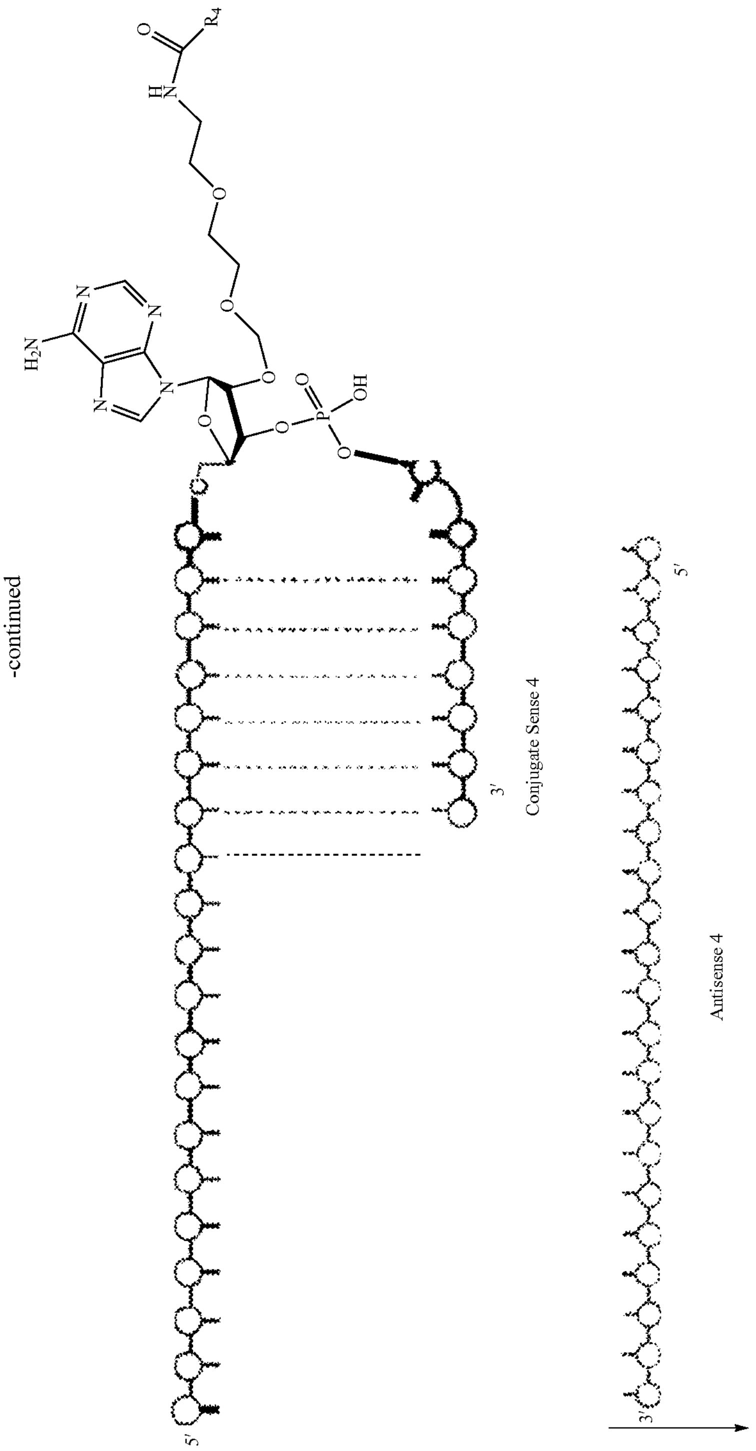
Conjugate Sense 4
Antisense 4

-continued
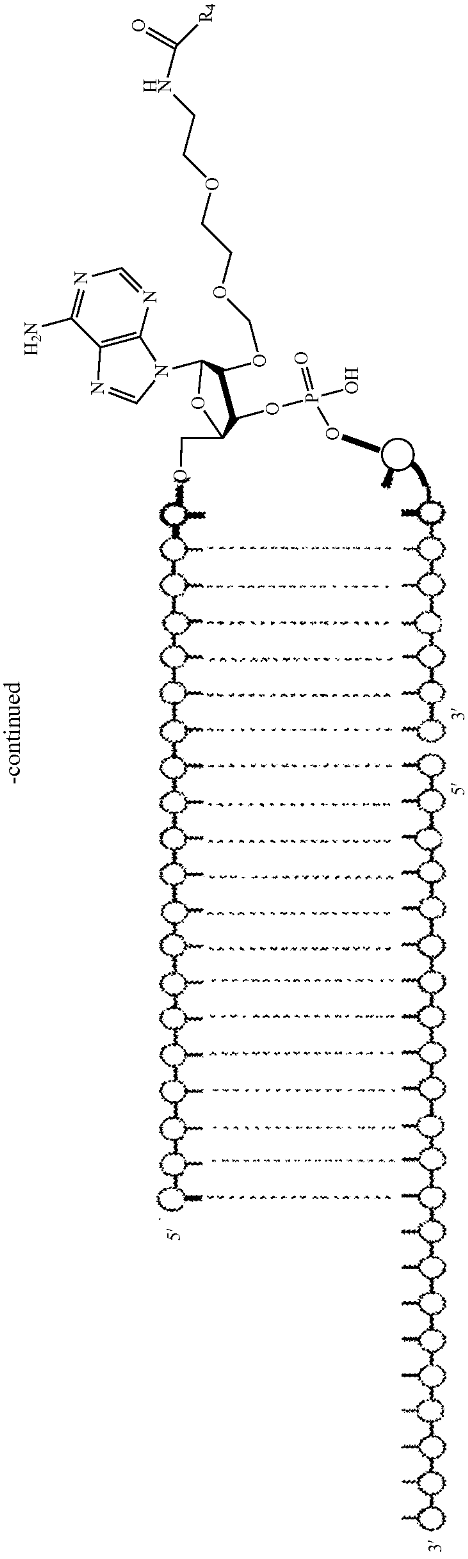
Duplex 4
Duplex 4a (SS-C22), $R_4$ =
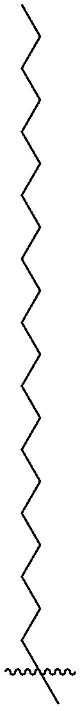

Sense 4 and Antisense 4 were Prepared by Solid-Phase Synthesis.

Conjugated Sense 4a was prepared using similar procedures as described for the synthesis of Conjugated Sense 1a and obtained in a 74% yield.

Duplex 4a (SS-C22) was prepared using the same procedures as described for the annealing of Duplex 1a (C8).

The following Scheme 1-6 depicts the synthesis of Nicked tetraloop GalXC conjugated with tri-adamantane moiety on the loop using post-synthetic conjugation approach.

Scheme 1-6
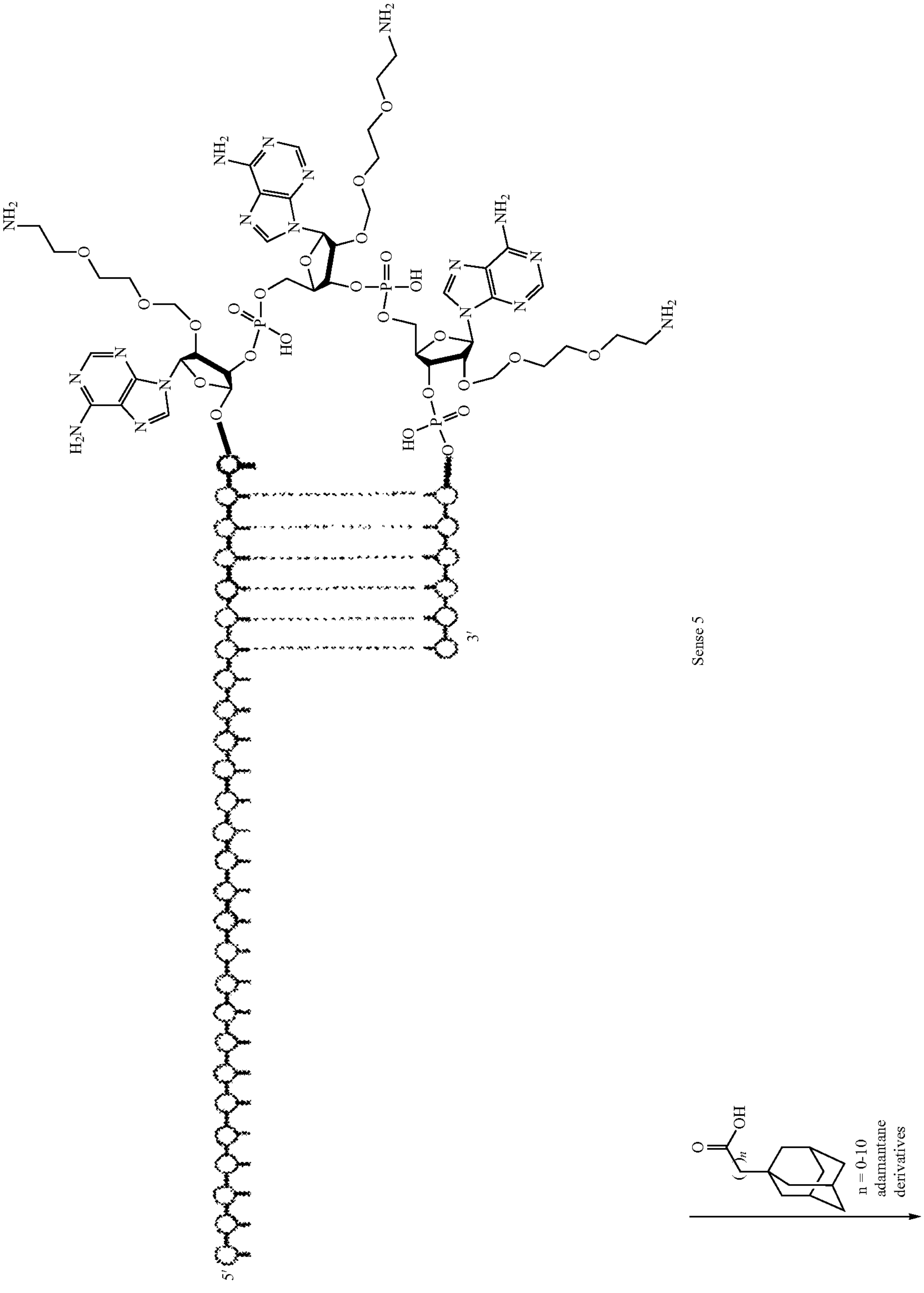
Sense 5

-continued
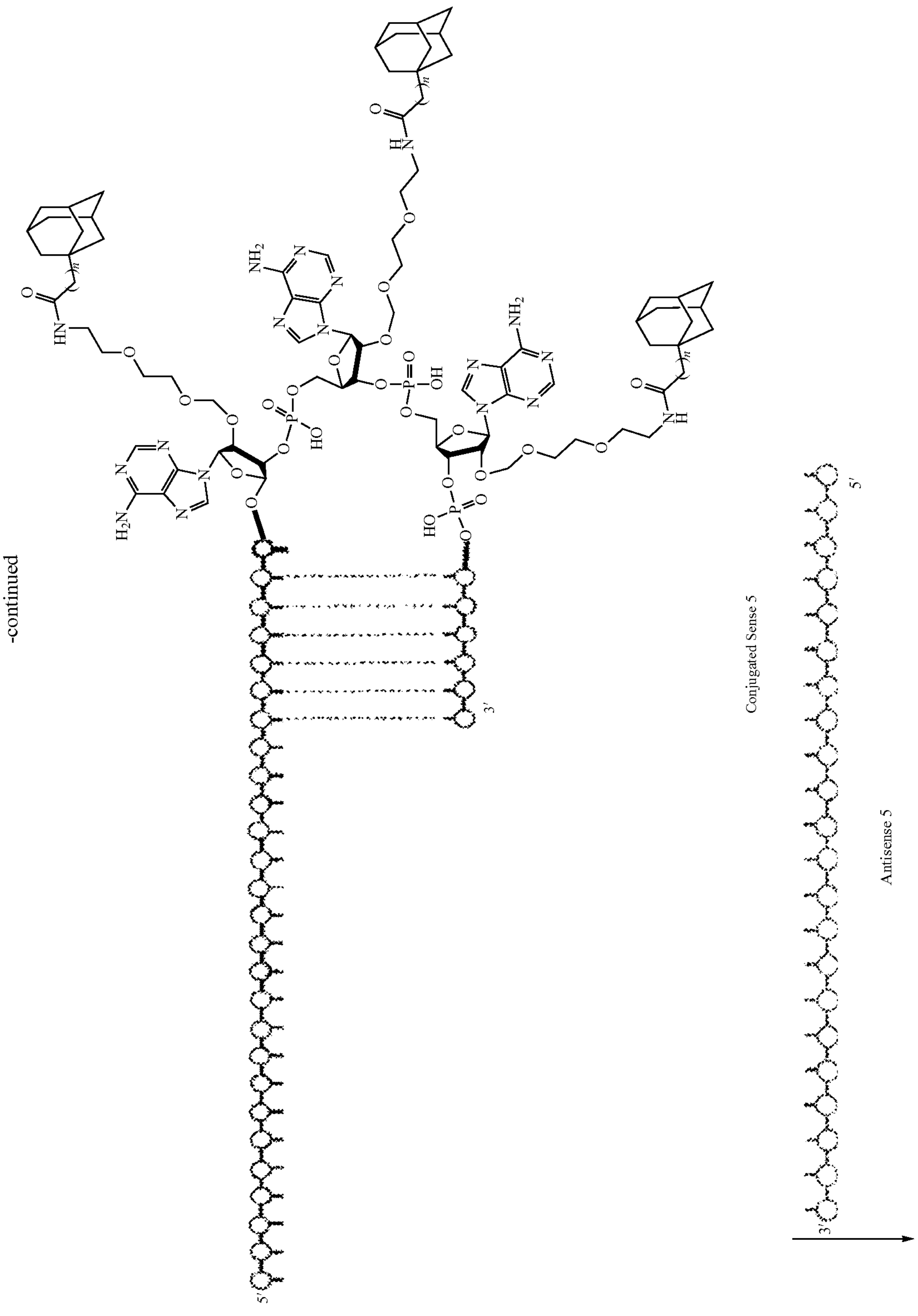
Conjugated Sense 5
Antisense 5

-continued
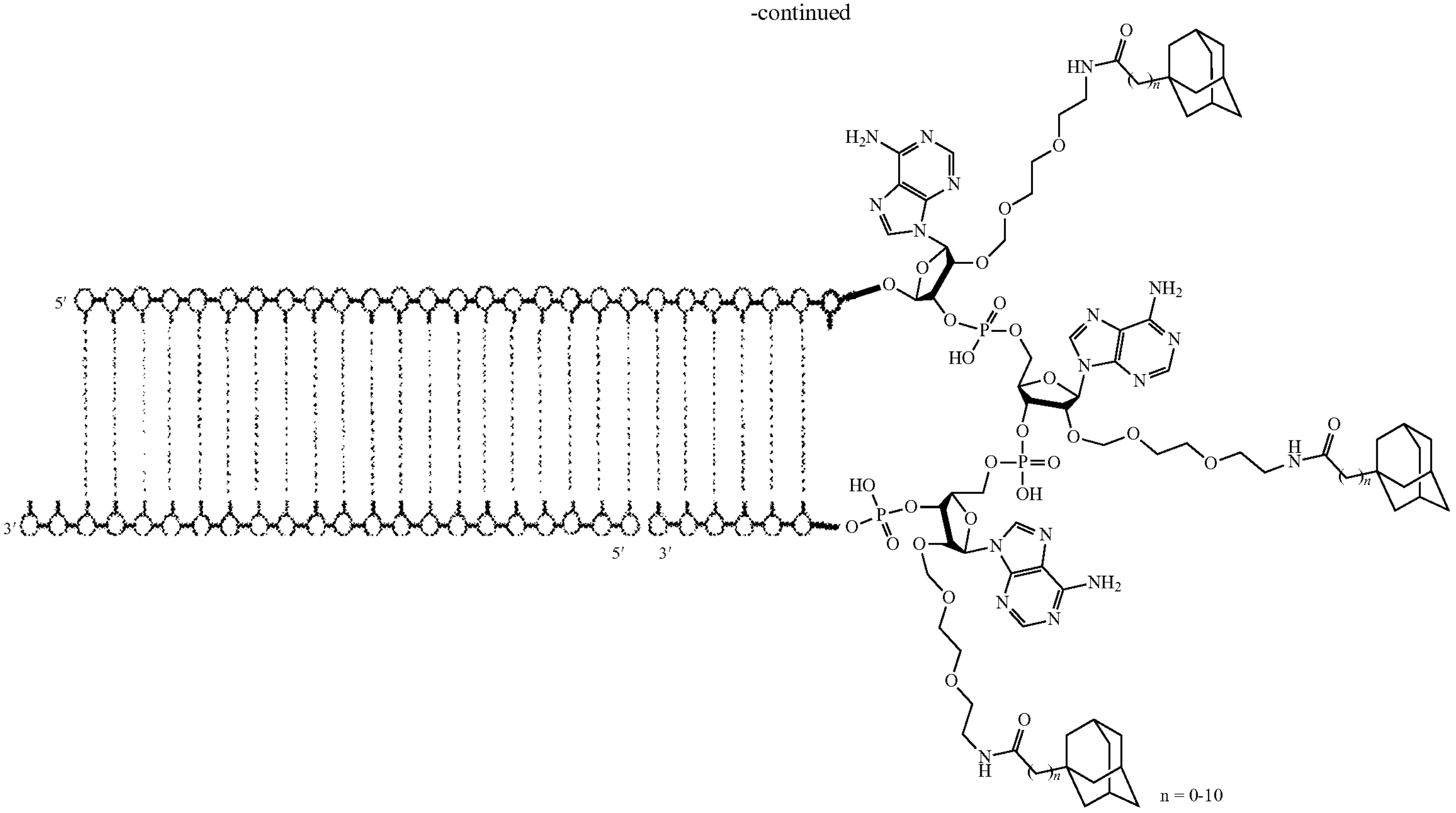
n = 0-10
Duplex 5
Duplex 5a (3Xadamantane), n = 0
Duplex 5b (3Xacetyladamantane), n = 1

Sense 5 and Antisense 5 were Prepared by Solid-Phase Synthesis.

Conjugated Sense 5a and 5b were prepared using similar procedures as described for the synthesis of Conjugated Sense 1a and obtained in 42%-73% yields.

Duplex 5a (3×adamantane) and Duplex 5b (3×acetyladamantane) were prepared using the same procedures as described for the annealing of Duplex 1a (C8).

The following scheme 1-7 depicts an example of solid phase synthesis of Nicked tetraloop GalXC conjugated with lipid(s) on the loop.

Scheme 1-7
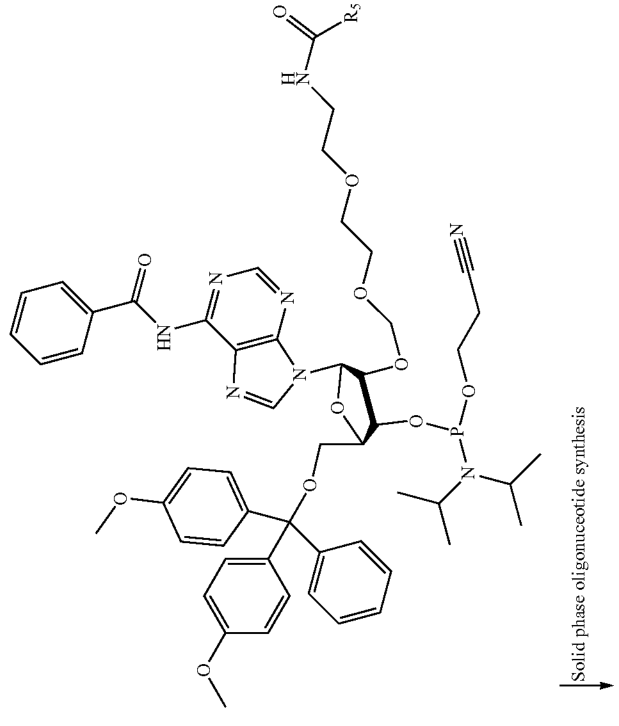

-continued
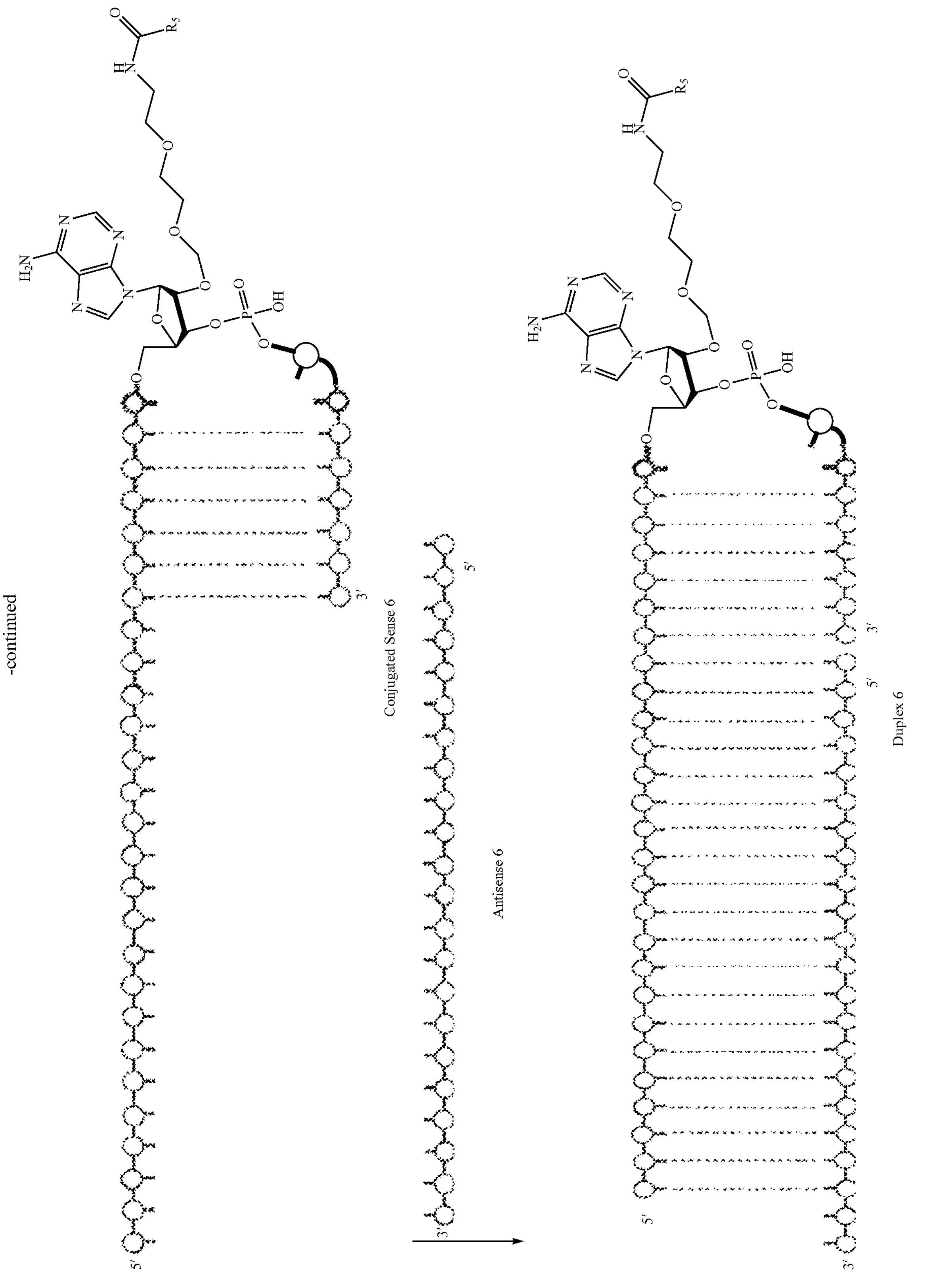
Conjugated Sense 6
Antisense 6
Duplex 6

Synthesis of Conjugated Sense 6.

Conjugated Sense 6 was prepared by solid-phase synthesis using a commercial oligo synthesizer. The oligonucleotides were synthesized using 2'-modified nucleoside phosphoramidites, such as 2'-F or 2'-OMe, and 2'-diethoxymethanol linked fatty acid amide nucleoside phosphoramidites. Oligonucleotide synthesis was conducted on a solid support in the 3' to 5'direction using a standard oligonucleotide synthesis protocol. In these efforts, 5-ethylthio-1H-tetrazole (ETT) was used as an activator for the coupling reaction. Iodine solution was used for phosphite triester oxidation. 3-(Dimethylaminomethylidene) amino-3H-1,2,4-dithiazole-3-thione (DDTT) was used for the formation of phosphorothioate linkages. Synthesized oligonucleotides were treated with concentrated aqueous ammonium for 10 h. The ammonia was removed from the suspension and the solid support residues were removed by filtration. The crude oligonucleotide was treated with TEAA, analyzed, and purified by strong anion exchange high performance liquid chromatography (SAX-HPLC). The fractions were combined and dialyzed against water (3×), saline (1×), and water (3×) using Amicon® Ultra-15 Centrifugal (3K). The remaining solvent was then lyophilized to afford the desired Conjugated Sense 6.

Duplex 6 was prepared using the same procedures as described for the annealing of Duplex 1a (C8).

Scheme 8. Synthesis of Nicked tetraloop GalXC conjugated with one adamantane unit on the loop via a post-synthetic conjugation approach.
Scheme 1-8
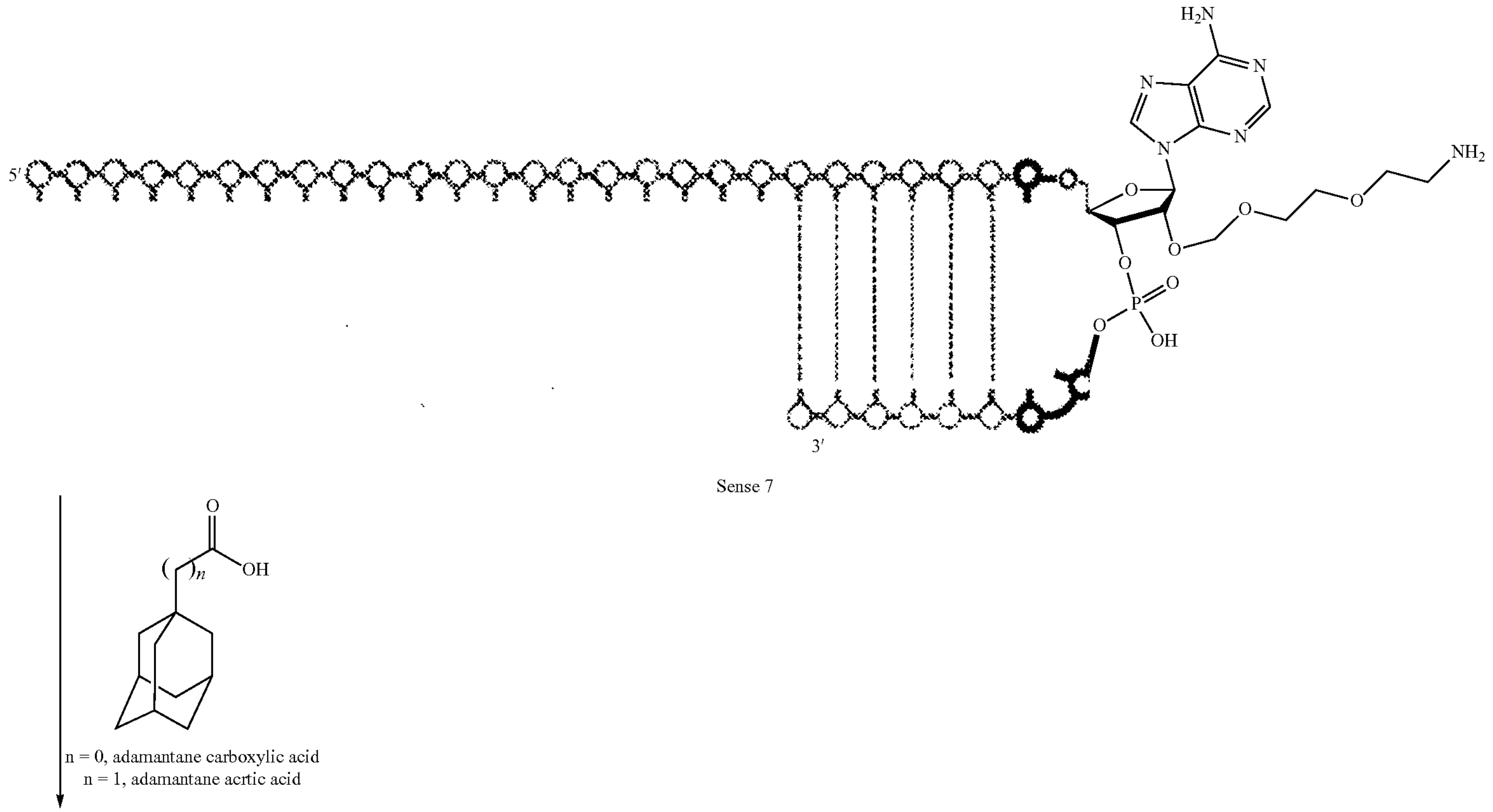
Sense 7

-continued
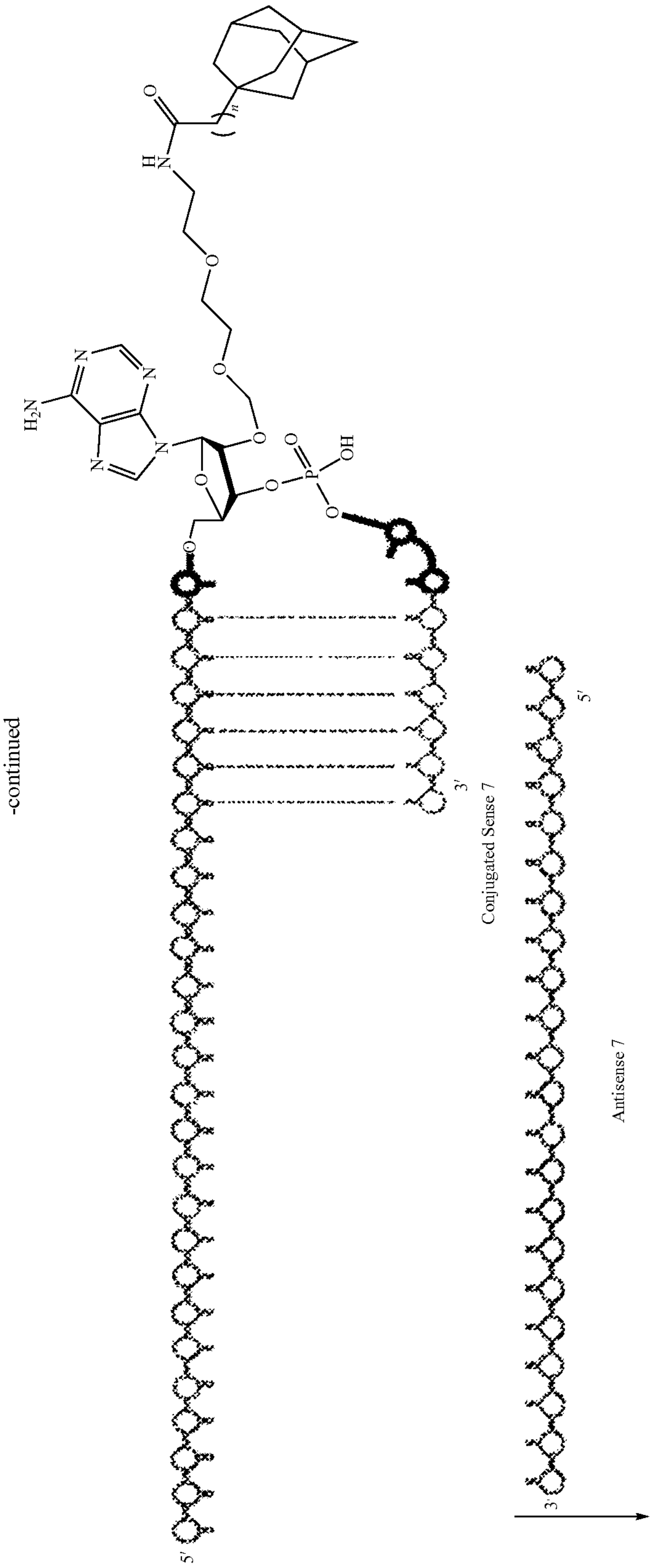
Conjugated Sense 7
Antisense 7

-continued
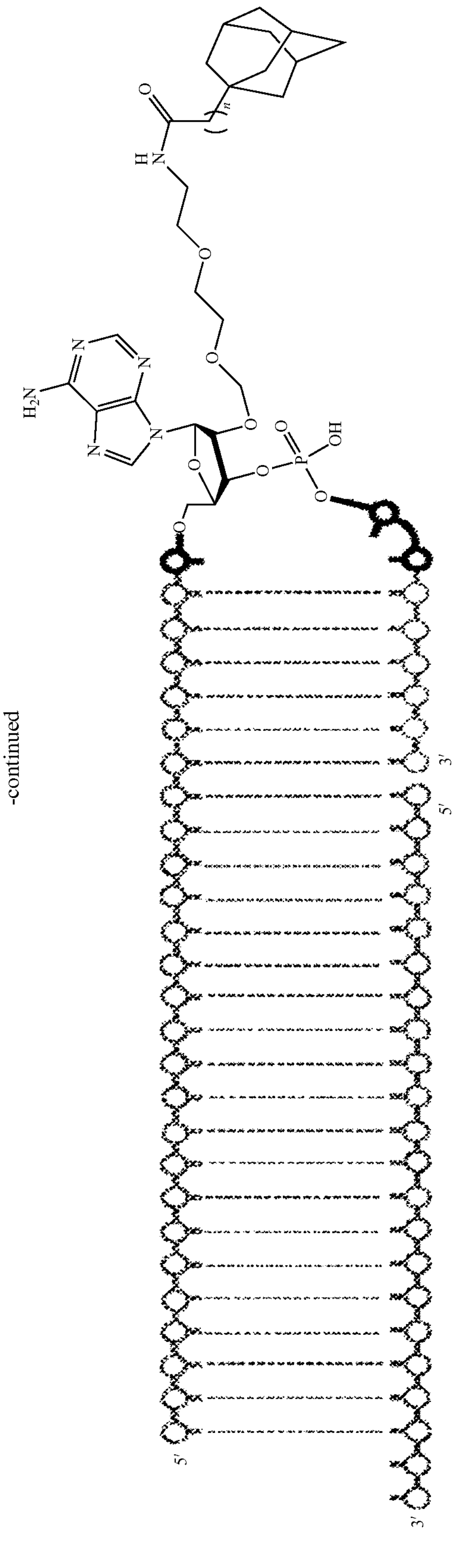
Duplex 7
7a, n =0
7b, n = 1
N = 0: Adamantane Carboxylic Acid; n = 1: Adamantane Acetic Acid Synthesis of Conjugated Sense 7a and 7b Conjugated Sense 7a and Sense 7b were obtained using the same method or a substantially similar method to the synthesis of Conjugated Sense 5.

Synthesis Example of Duplex 7a and 7b

Duplex 7a and Duplex 7b were obtained using the same method or a substantially similar method to the synthesis of Duplex 5.

Scheme 9. Synthesis of nicked tetraloop GalXC conjugated with two adamantane units on the loop via a post-synthetic conjugation approach.
Scheme 1-9
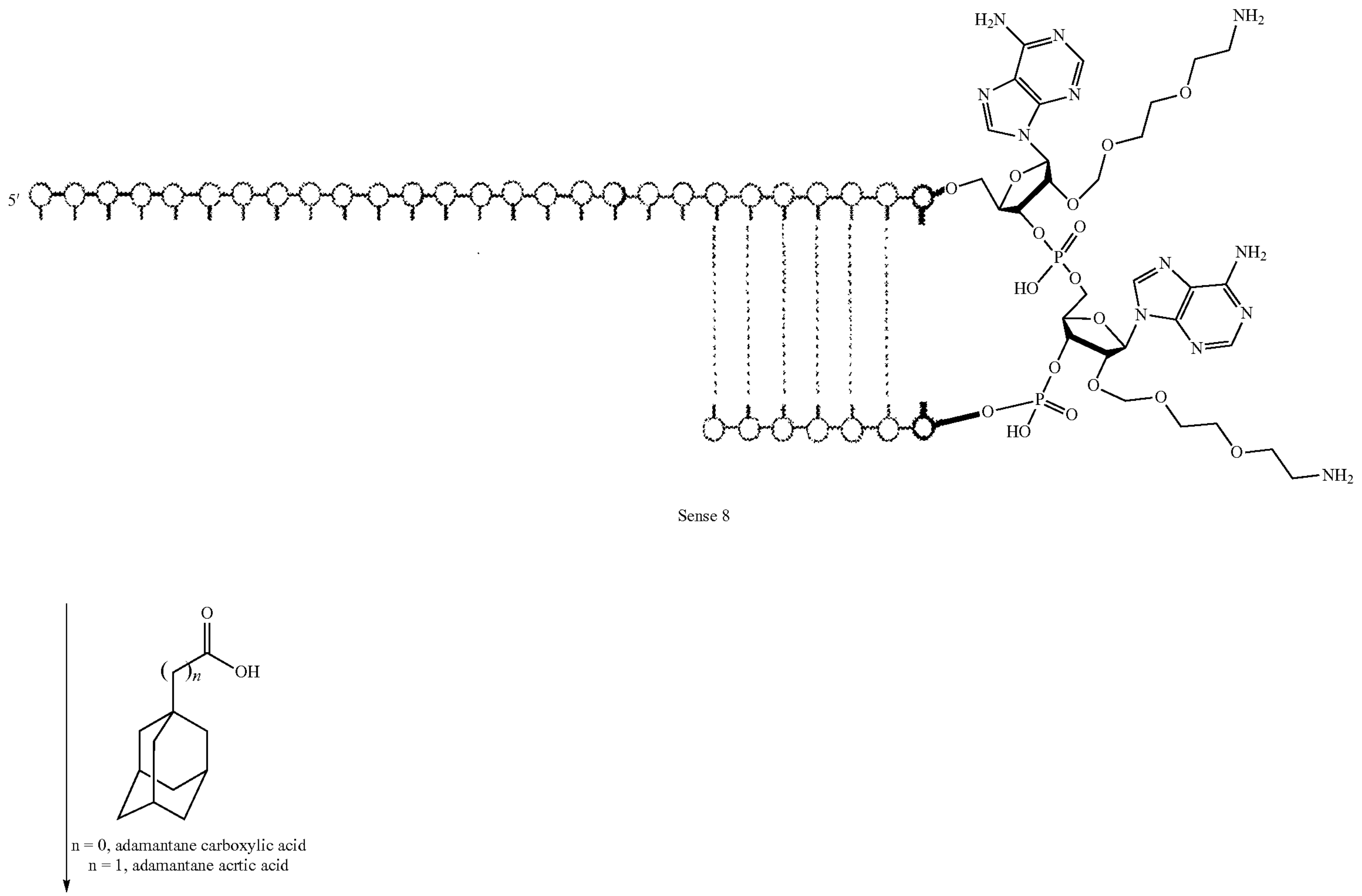
Sense 8

-continued
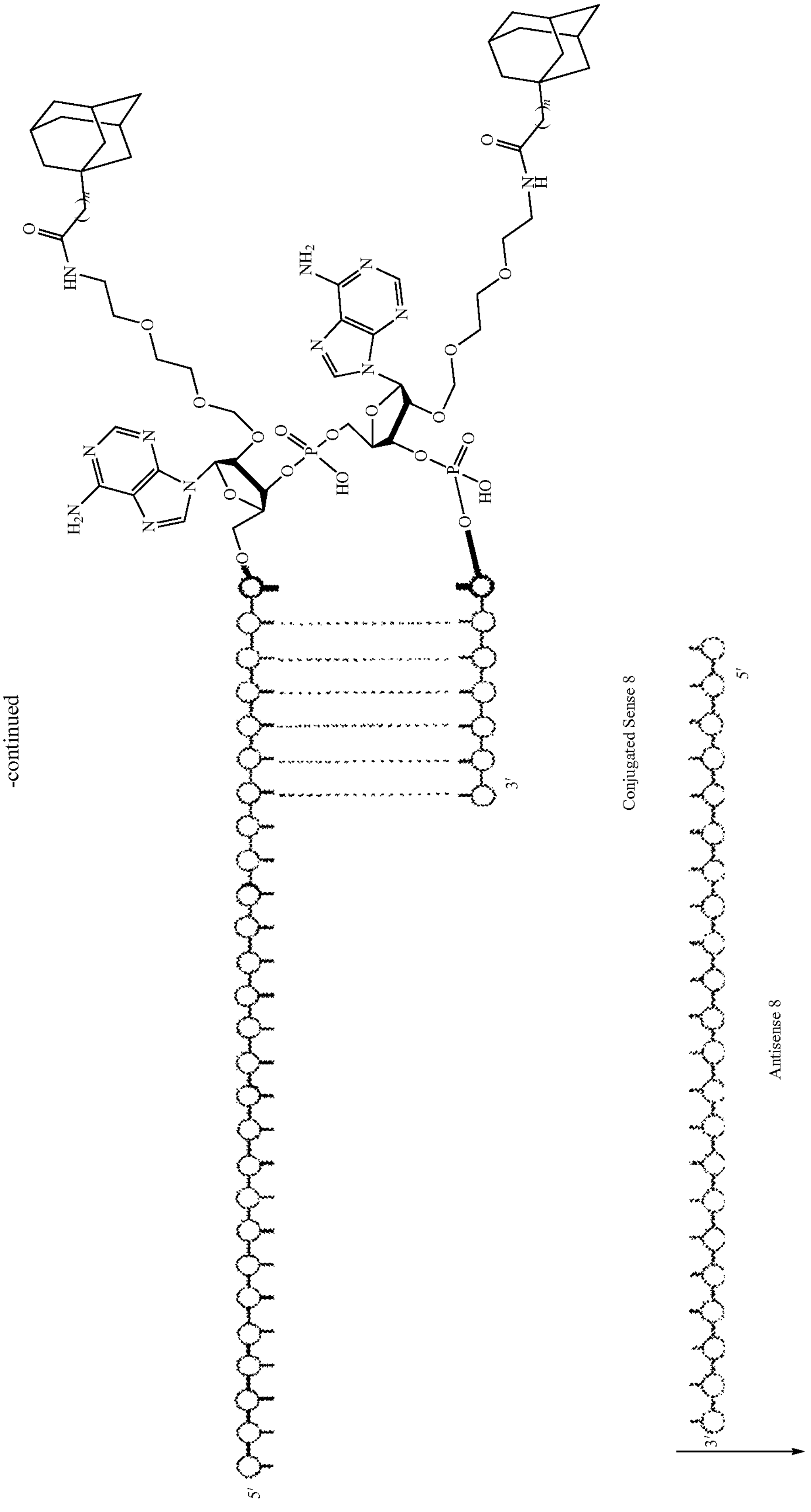
Conjugated Sense 8
Antisense 8

-continued
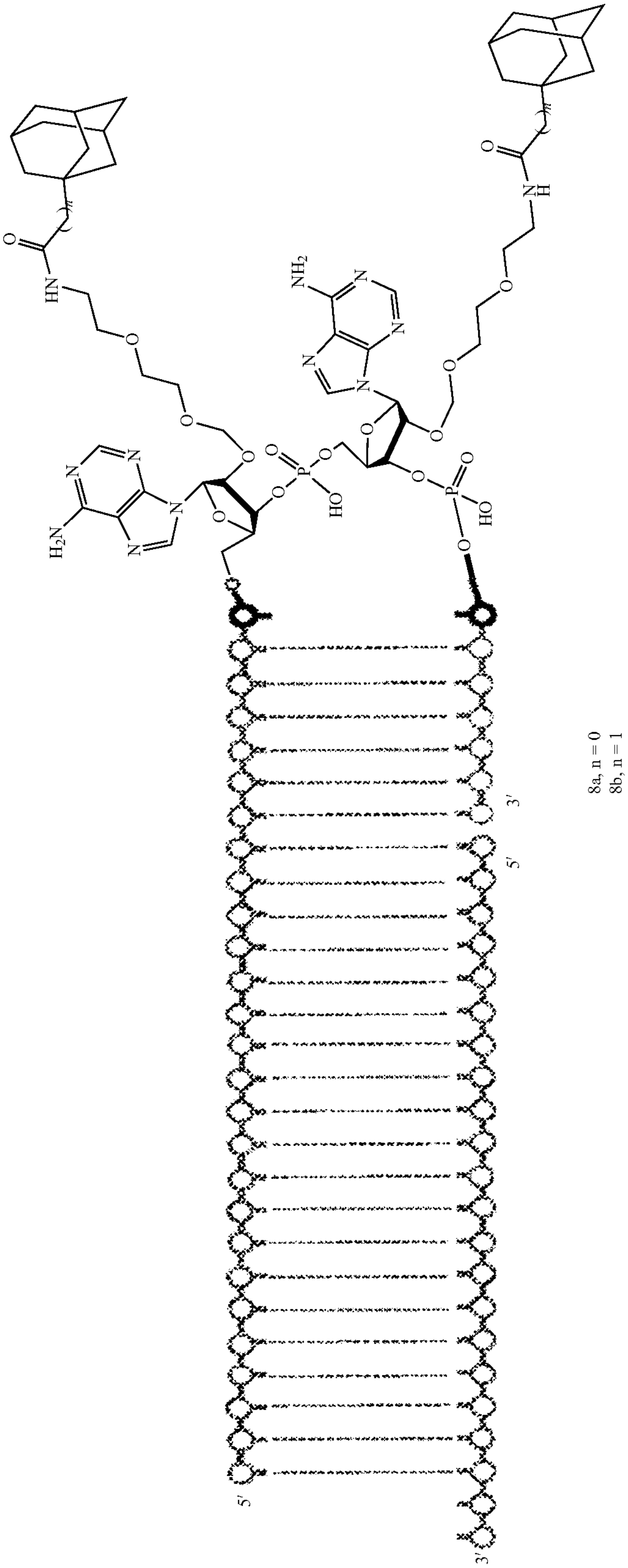
8a, n = 0
8b, n = 1
Duplex 8

Synthesis of Conjugated Sense 8a and 8b

Conjugated Sense 8a and Sense 8b were obtained using the same method or a substantially similar method to the synthesis of Conjugated Sense 5.

Synthesis Example of Duplex 8a and 8b

Duplex 8a and Duplex 8b were obtained using the same method or a substantially similar method to the synthesis of Duplex 5.

The following Scheme 1-10 depicts the synthesis of GalXC of short sense and short stem loop conjugated with mono-lipid using post-synthetic conjugation approach.

Scheme 1-10
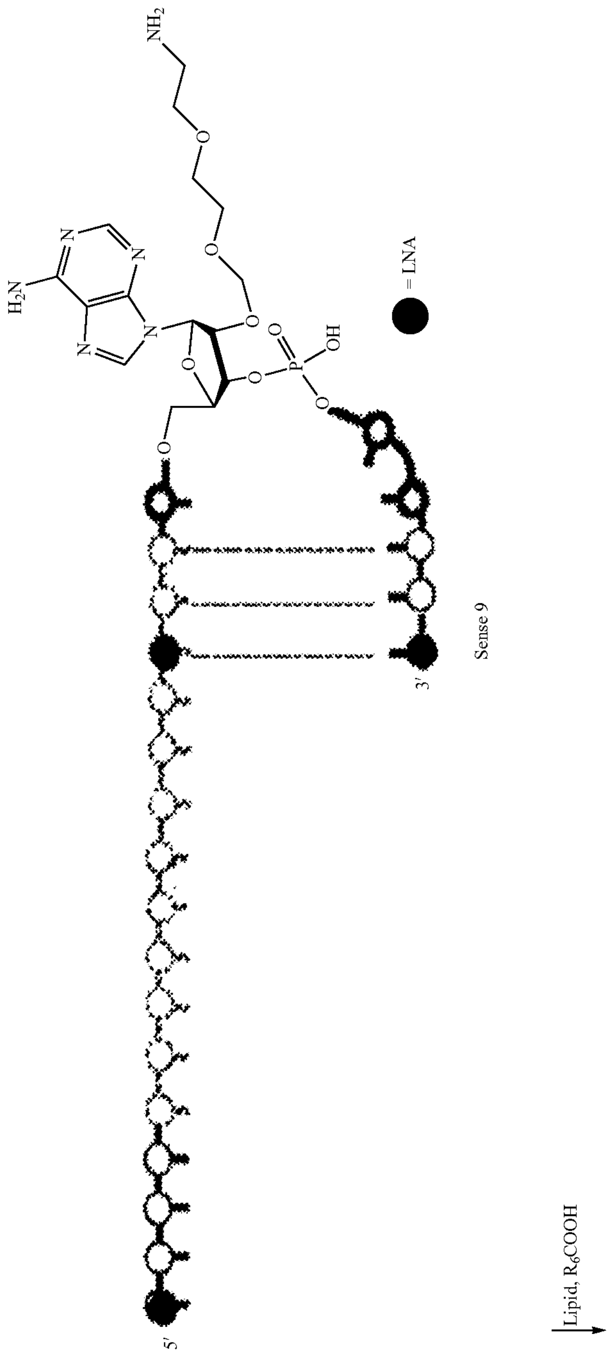

-continued
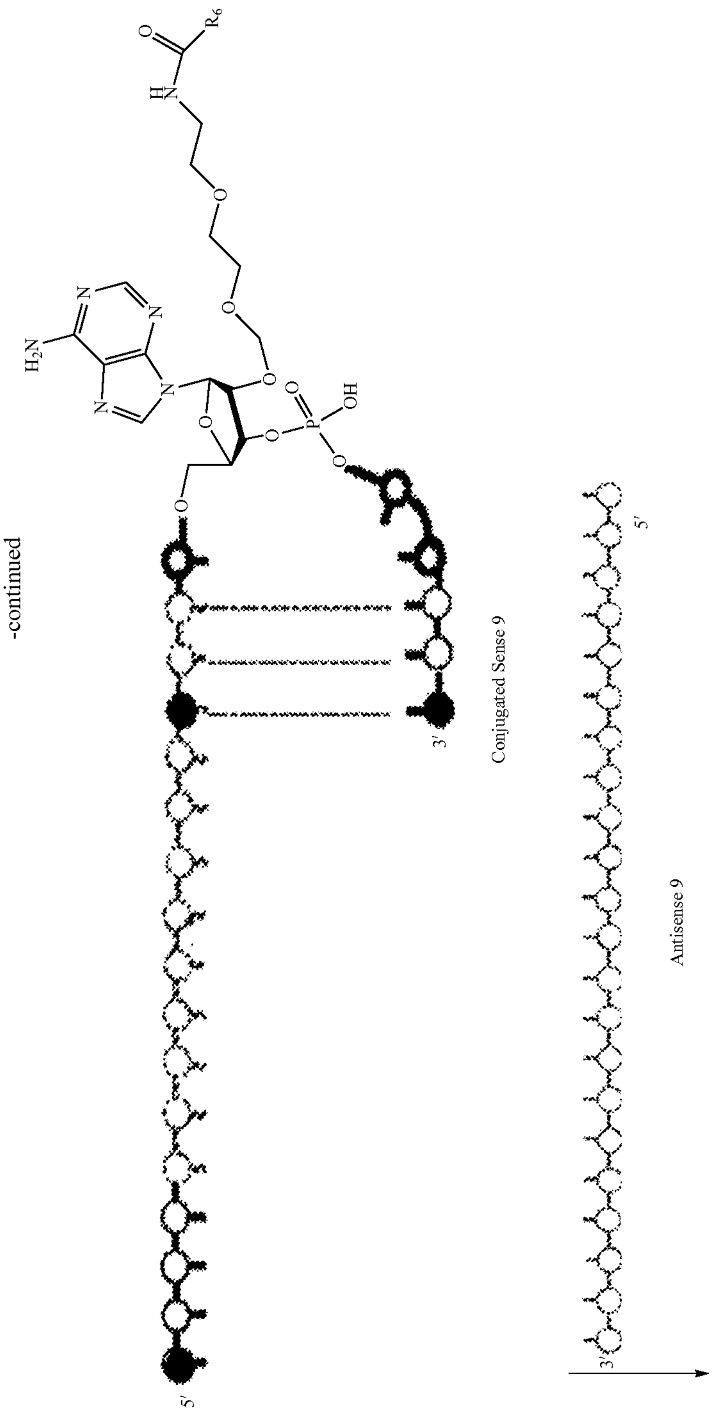
Conjugated Sense 9
Antisense 9

-continued
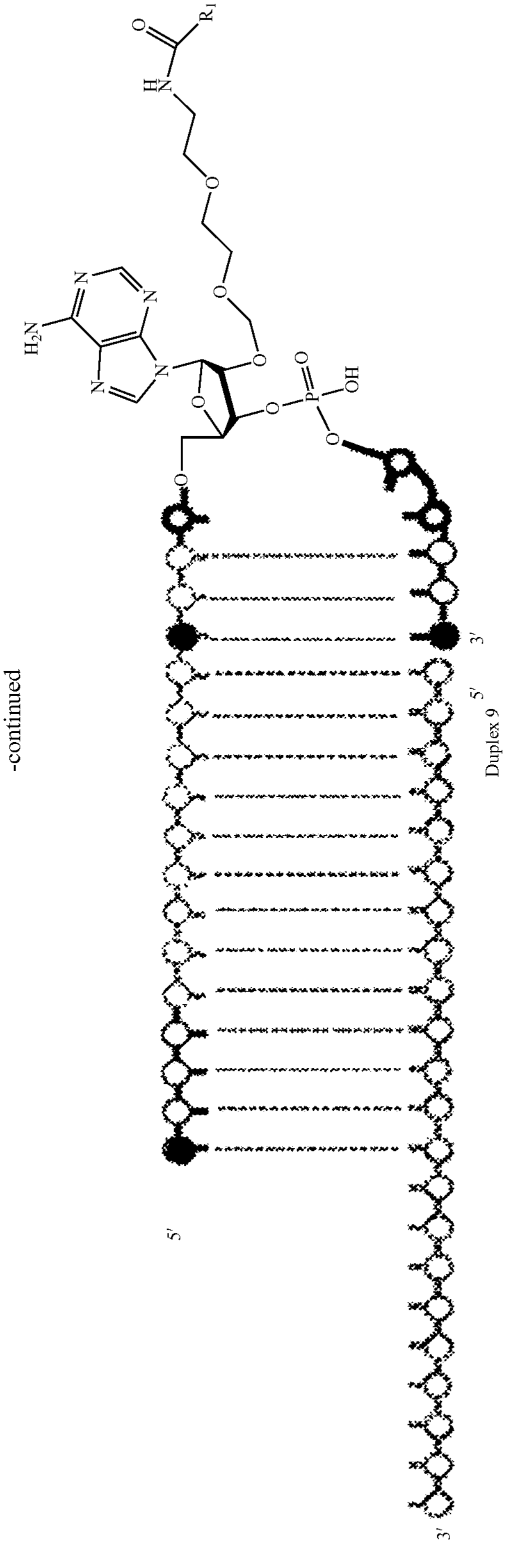
Duplex 9
Duplex 9a, $R_6$ =
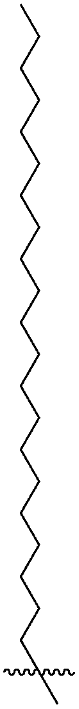

Synthesis of Sense 9a

Conjugated Sense 9a was obtained using the same method or a substantially similar method to the synthesis of Conjugated Sense 5.

Synthesis Example of Duplex 9a

Duplex 9a was obtained using the same method or a substantially similar method to the synthesis of Duplex 5.

The following Scheme 1-11 depicts the synthesis of GalXC conjugated with mono-lipid at 5'-end using post-synthetic conjugation approach.

Scheme 1-11
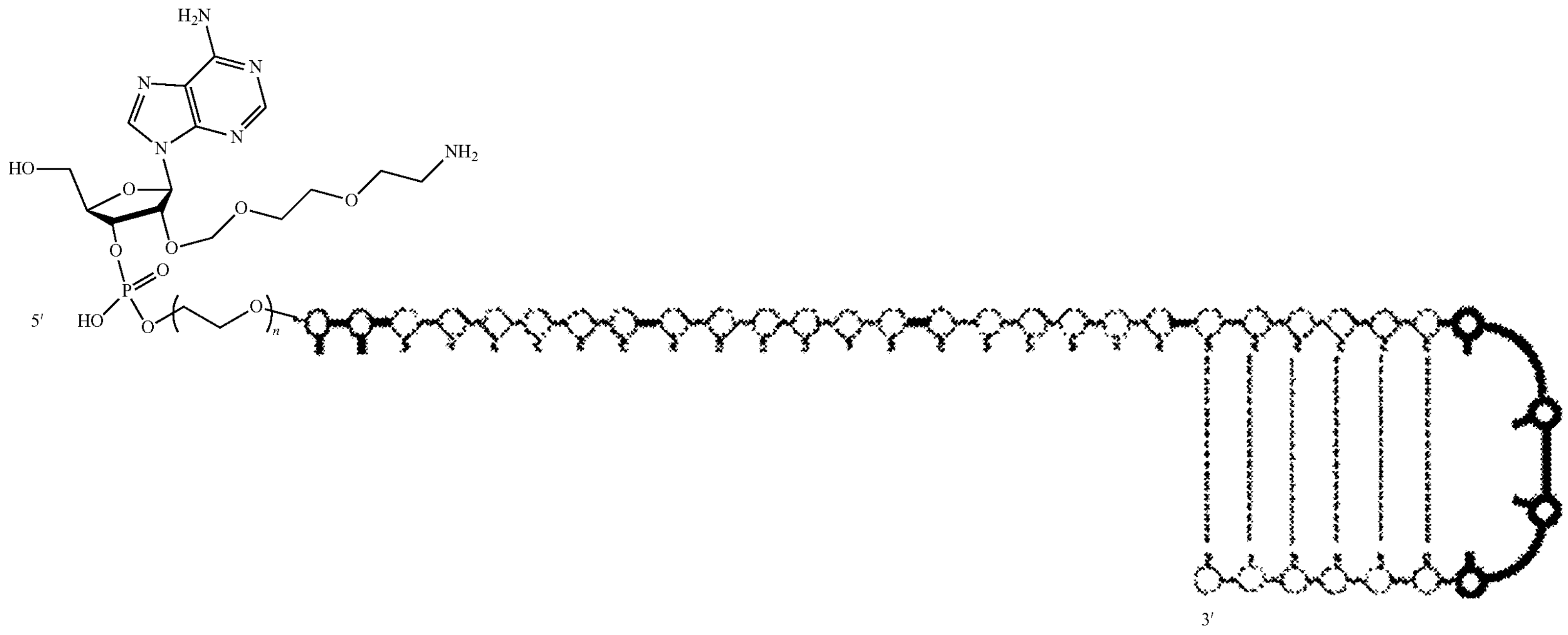
Sense 10
Lipid, $R_7COOH$

-continued
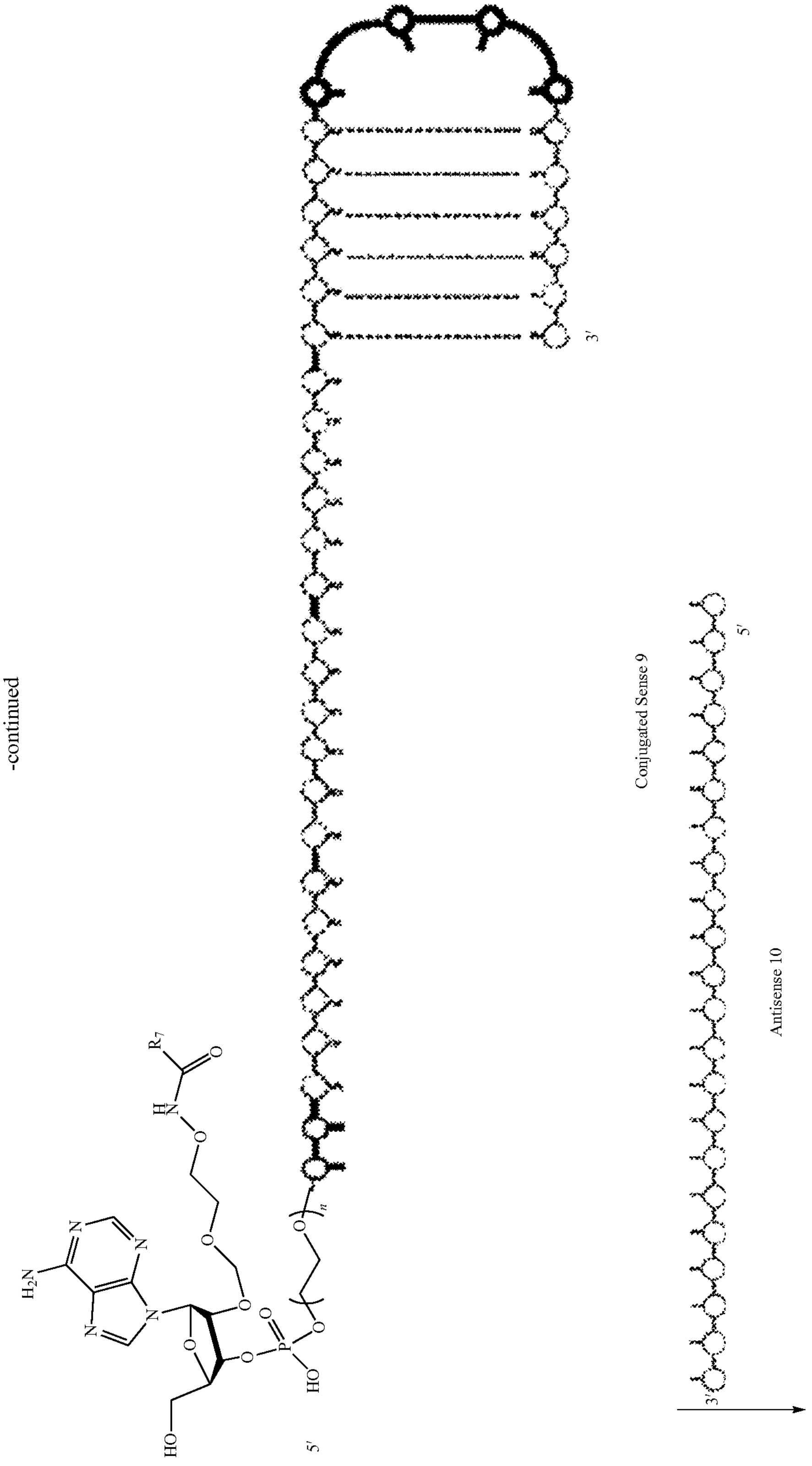
Conjugated Sense 9
Antisense 10

-continued
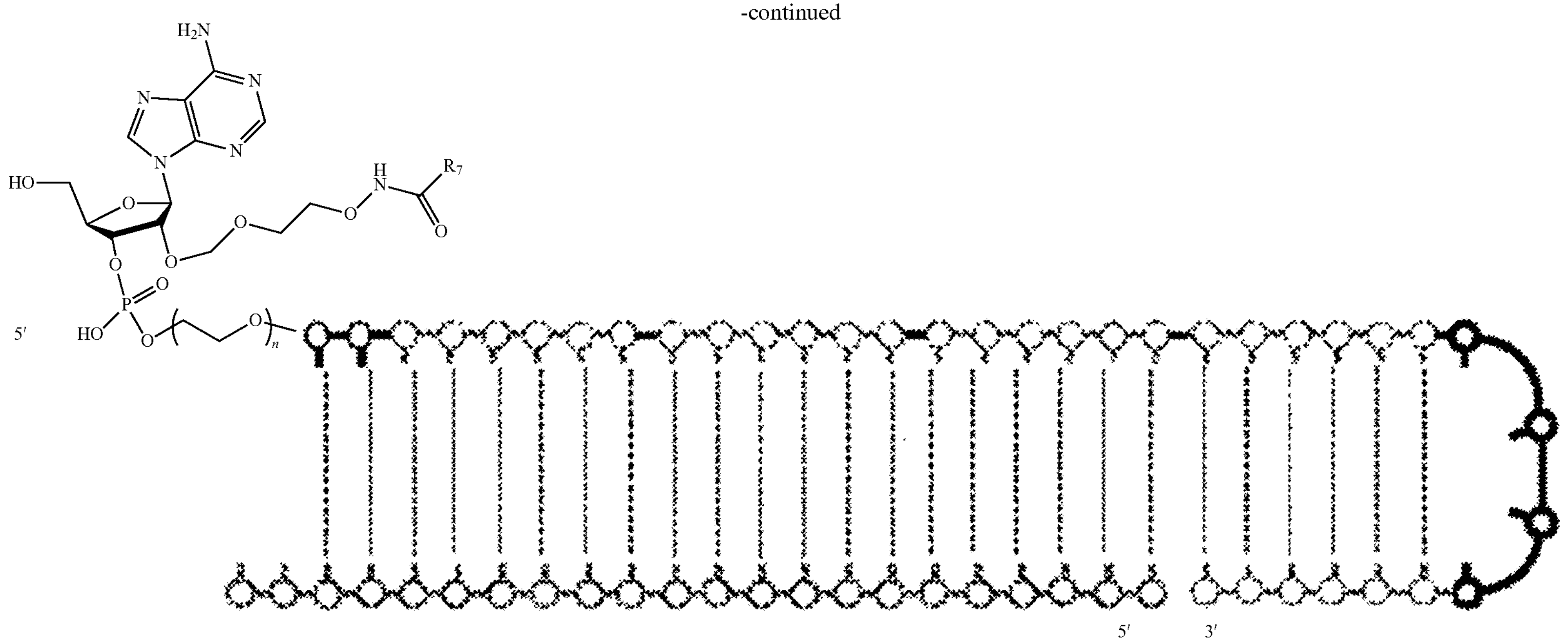
Duplex 10
Duplex 10a (C22), $R_7$ =
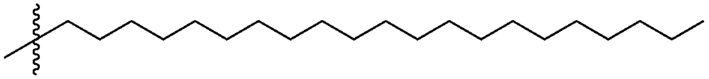

Synthesis of Conjugated Sense 10a

Conjugated Sense 10a was obtained using the same method or a substantially similar method to the synthesis of Conjugated Sense 5.

Synthesis Example of Duplex 10a

Duplex 10a was obtained using the same method or a substantially similar method to the synthesis of Duplex 5.

The following Scheme 1-12a and 1-12b depict the synthesis of GalXC with blunt end conjugated with mono-lipid at 3'-end or 5'-end using post-synthetic conjugation approach.

Scheme 1-12a

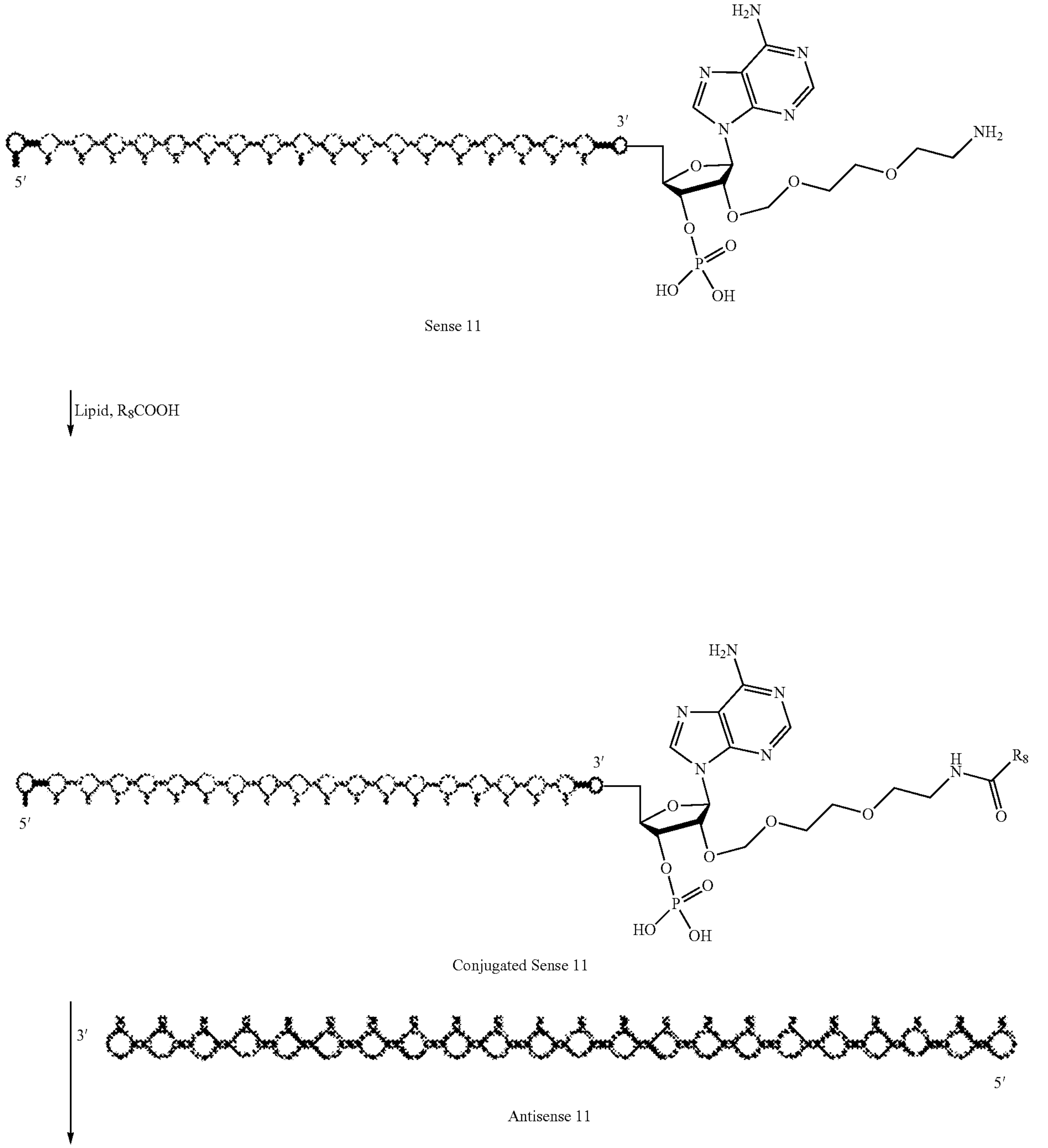

Sense 11

Conjugated Sense 11

Antisense 11

-continued
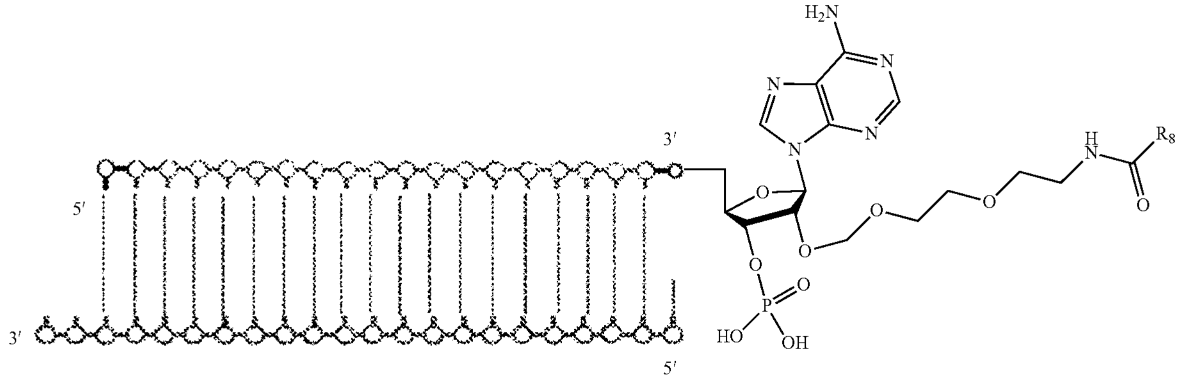
Duplex 11
Duplex 11a (C22), $R_8$ =
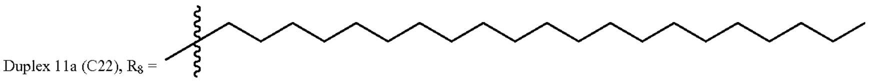 [SMILES: *CCCCCCCCCCCCCCCCCCCCC]
Scheme 1-12b
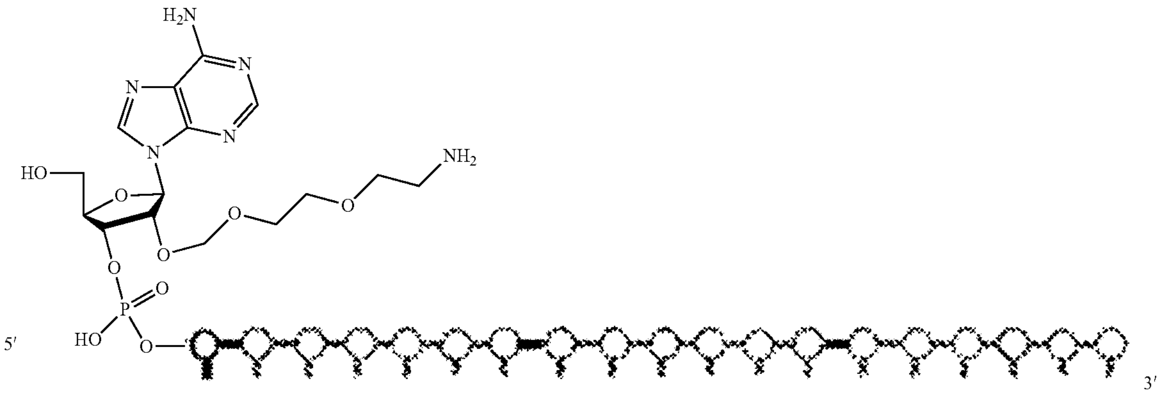
Sense 12
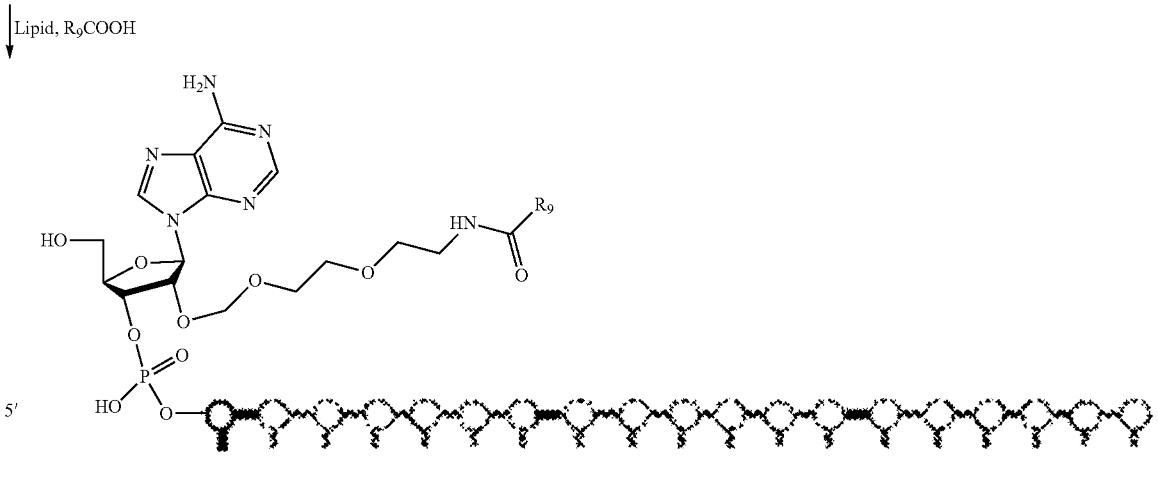
Conjugated Sense 12
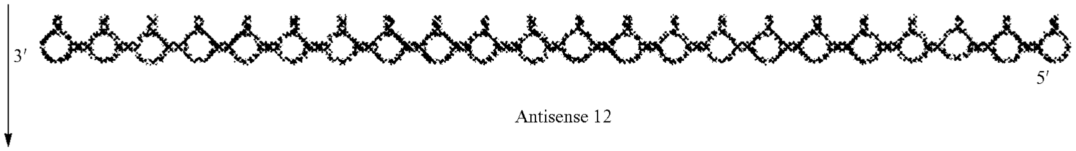
Antisense 12

-continued

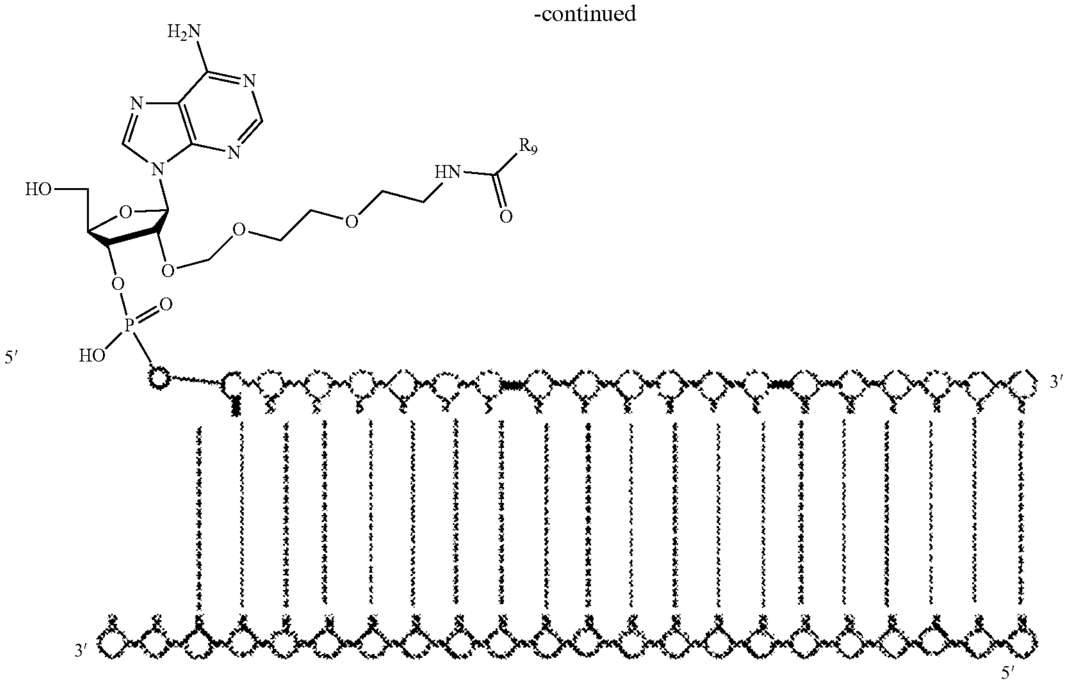

Duplex 12

Duplex 12a (C22), $R_9$ = 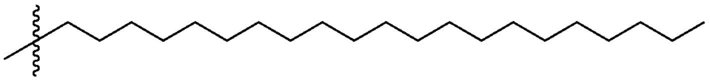

Synthesis of Conjugated Sense 11a and 12a

Conjugated Sense 11a and 12a were obtained using the same method or a substantially similar method to the synthesis of Conjugated Sense 5.

Synthesis Example of Duplex 11a and 12a

Duplex 11a and 12a were obtained using the same method or a substantially similar method to the synthesis of Duplex 5.

Conjugates Duplex 8D and Duplex 9D were obtained using the same method or a substantially similar method to the synthesis of Duplex 5.

Figure 1B:
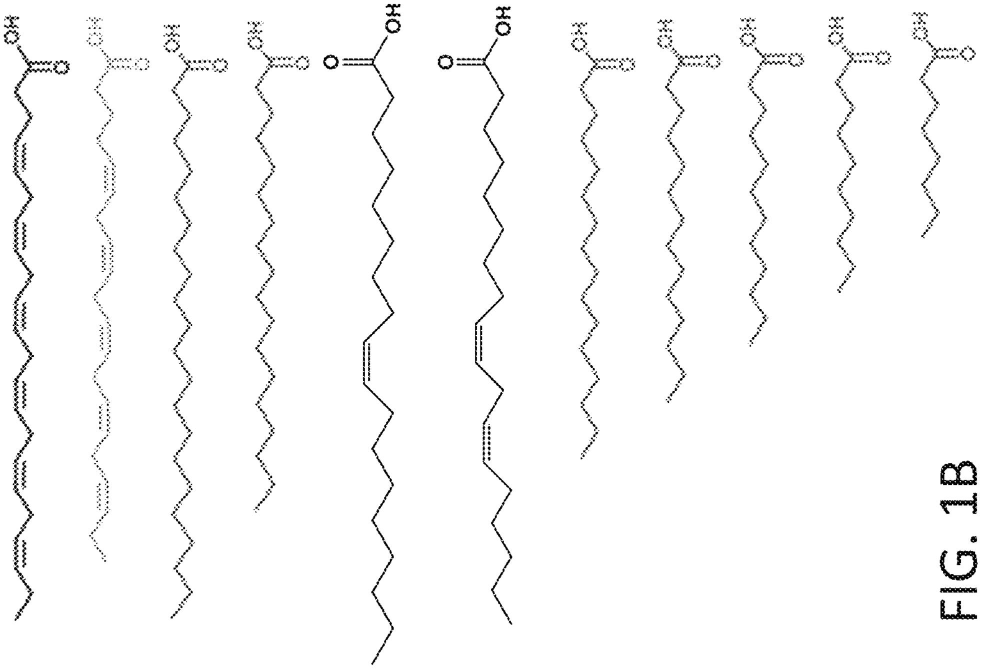
FIG. 1B provides structures of lipid tails suitable for conjugation to RNAi oligonucleotide molecules.

Later, acyl chains were conjugated to a nucleic acid inhibitor molecule that targets the STAT3 gene, a gene that is expressed in the tissues of interest. A passenger strand with 2'-amine linkers [ademA] was used for post solid phase conjugation. Different types of lipids were conjugated using the same chemistry to generate a series of conjugates (FIGS. 1A and 1B). SAR studies were performed to identify a lipid conjugate that could be used to deliver payloads to the tissues of interest in order to mediate target knockdown.

Example 3: Tissue Specific Targets in MDSC Cell Populations and Tumor Draining Lymph Nodes STAT3 is involved in immune suppression with examples abundantly reported in literature. Targeting STAT3 transcription through an RNAi mechanism could potentially overcome the challenges in the development of pharmacological STAT3 inhibitors. For these reasons STAT3 was selected as a proof-of-concept target to demonstrate tissue specific activity in the tissues of interest, such as myeloid derived suppressor cells (MDSCs). STAT3 sequences were designed in the GalXC format with described modification patterns and screening for target knockdown in liver tissue was performed in normal CD-1 mice. Eighteen STAT3-GalXC conjugates (Table 1) were dosed once subcutaneously at 3 mg/kg.

TABLE 1

GalXC Compound Candidates for Identifying Tool Compounds for Proof-of-concept Studies in Mice:

| Oligo | DP # | Sequence Type | SEQ ID NO | SEQ ID NO | Conjugate |
|---|---|---|---|---|---|
| GalXC- | DP21679P: | Unmodified | 9 | 10 | GalNAc |
| STAT3-838 | DP21678G | Modified | 11 | 12 | GalNAc |
| GalXC- | DP21697P: | Unmodified | 13 | 14 | GalNAc |
| STAT3-1390 | DP21696G | Modified | 15 | 16 | GalNAc |
| GalXC- | DP21677P: | Unmodified | 17 | 18 | GalNAc |
| STAT3-1394 | DP21676G | Modified | 19 | 20 | GalNAc |
| GalXC- | DP21691P: | Unmodified | 21 | 22 | GalNAc |
| STAT3-1398 | DP21690G | Modified | 23 | 24 | GalNAc |
| GalXC- | DP21671P: | Unmodified | 25 | 26 | GalNAc |
| STAT3-1399 | DP21670G | Modified | 27 | 28 | GalNAc |
| GalXC- | DP21673P: | Unmodified | 29 | 30 | GalNAc |
| STAT3-1400 | DP21672G | Modified | 31 | 32 | GalNAc |
| GalXC- | DP21687P: | Unmodified | 33 | 34 | GalNAc |
| STAT3-1401 | DP21686G | Modified | 35 | 36 | GalNAc |
| GalXC- | DP21675P: | Unmodified | 37 | 38 | GalNAc |
| STAT3-1402 | DP21674G | Modified | 39 | 40 | GalNAc |
| GalXC- | DP21701P: | Unmodified | 41 | 42 | GalNAc |
| STAT3-1759 | DP21700G | Modified | 43 | 44 | GalNAc |
| GalXC- | DP21689P: | Unmodified | 45 | 46 | GalNAc |
| STAT3-2029 | DP21688G | Modified | 47 | 48 | GalNAc |
| GalXC- | DP21693P: | Unmodified | 49 | 50 | GalNAc |
| STAT3-2034 | DP21692G | Modified | 51 | 52 | GalNAc |
| GalXC- | DP21699P: | Unmodified | 53 | 64 | GalNAc |
| STAT3-2448 | DP21698G | Modified | 55 | 56 | GalNAc |

TABLE 1-continued

| GalXC Compound Candidates for Identifying Tool Compounds for Proof-of-concept Studies in Mice: | | | | | |
|---|---|---|---|---|---|
| Oligo | DP # | Sequence Type | SEQ ID NO | SEQ ID NO | Conjugate |
| GalXC-STAT3-2527 | DP21695P: | Unmodified | 57 | 58 | GalNAc |
| | DP21694G | Modified | 59 | 60 | GalNAc |
| GalXC-STAT3-4107 | DP21683P: | Unmodified | 61 | 62 | GalNAc |
| | DP21682G | Modified | 63 | 64 | GalNAc |
| GalXC-STAT3-4110 | DP21669P: | Unmodified | 65 | 66 | GalNAc |
| | DP21668G | Modified | 67 | 68 | GalNAc |
| GalXC-STAT3-4123 | DP21667P: | Unmodified | 69 | 70 | GalNAc |
| | DP21666G | Modified | 71 | 72 | GalNAc |
| GalXC-STAT3-4435 | DP21685P: | Unmodified | 73 | 74 | GalNAc |
| | DP21684G | Modified | 75 | 76 | GalNAc |
| GalXC-STAT3-4474 | DP21681P: | Unmodified | 77 | 78 | GalNAc |
| | DP21680G | Modified | 79 | 80 | GalNAc |

Figure 2A:
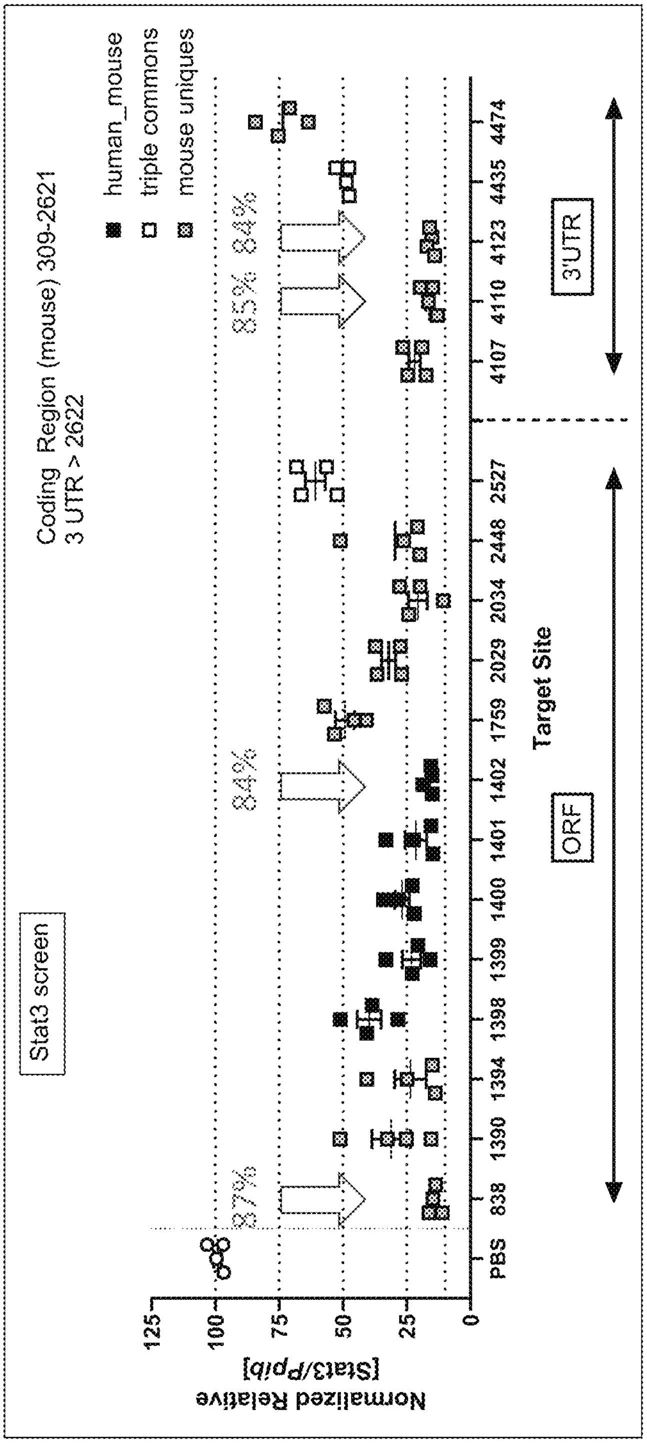
FIGS. 2A and 2B are graphs showing remaining mouse Stat3 mRNA levels in the livers of mice treated with GalXC-STAT3-conjugates (GalNAc conjugates) targeting different regions of Stat3 mRNA. Mice were administered a single dose (3 mg/kg) (FIG. 2A) and or varying doses (0.3, 1.0, or 3.0 mg/kg) to determine dose responsiveness (FIG. 2B). Arrows indicate constructs selected for further study.
Figure 2B:
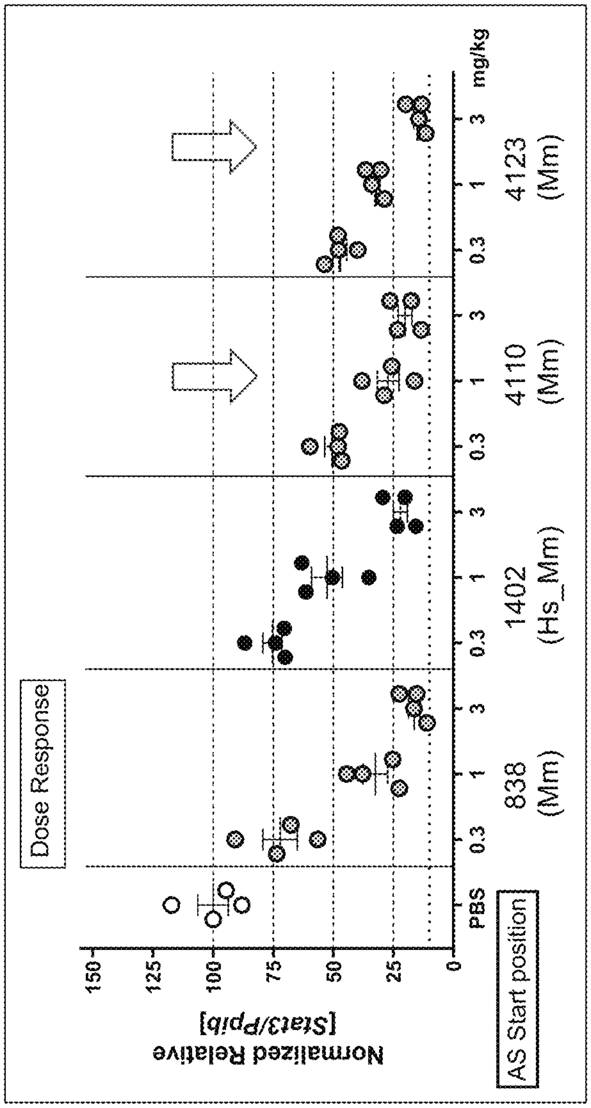

Five days post injection, livers were collected and subjected to mRNA analysis by qPCR. As a result of the screen, four sequences (GalXC-STAT3-838, GalXC-STAT3-1402, GalXC-STAT3-4110 and GalXC-STAT3-4123) that showed >85% target knockdown in liver were selected for further evaluation (FIG. 2A). Of these sequences three were identified as mouse specific and one was identified as human-mouse cross-reactive. These 4 sequences were further screened in CD-1 mice at 3 different doses (0.3, 1 and 3 mg/kg) to assess the dose response. GalXC-STAT3-4110 and 4123 were identified as the most potent sequences after the dose response screen, each with $ED_{50}$ of 0.3 mg/kg and thus these molecules were selected for further studies (FIG. 2B). C18 lipid conjugation was performed for both GalXC-STAT3-4110 or 4123 for proof-of-concept studies (Table 2).

TABLE 2

| GalXC-STAT3 Lipid Conjugates | | | |
|---|---|---|---|
| SEQ ID | Oligonucleotide | Sequence Type | Ligand |
| 81 | GalXC-STAT3-4110-C18 | Modified Sense strand | C18 |
| 82 | | Modified Antisense strand | C18 |
| 83 | GalXC-STAT3-4123-C18 | Modified Sense strand | C18 |
| 84 | | Modified Antisense strand | C18 |

TABLE 3

| GalXC-STAT3 Lipid Conjugates | | | | |
|---|---|---|---|---|
| Oligo | Sequence Type | Sense strand SEQ ID NO | Antisense strand SEQ ID NO | Conjugate |
| GalXC-STAT3-4110-C18 | Unmodified | 65 | 66 | C18 |
| | Modified | 81 | 82 | C18 |
| GalXC-STAT3-4123-C18 | Unmodified | 69 | 70 | C18 |
| | Modified | 83 | 84 | C18 |

Figure 3A:
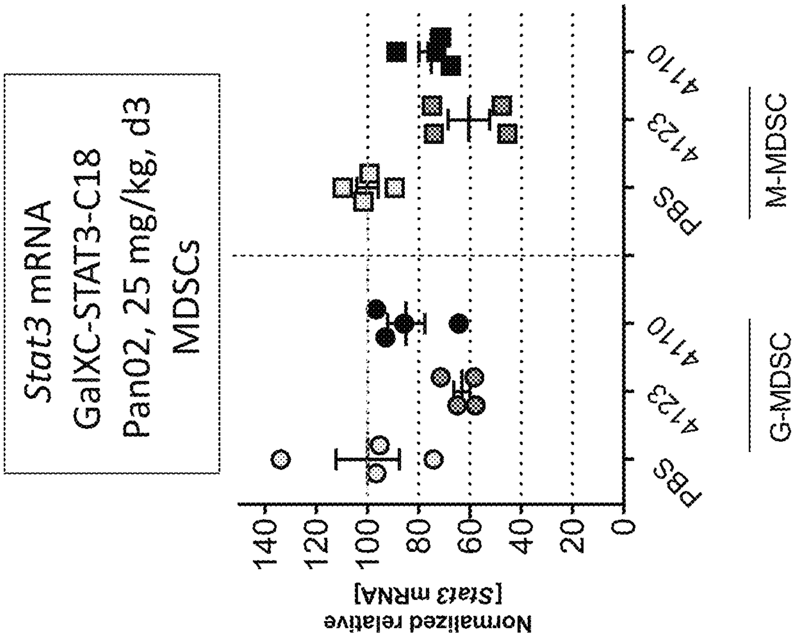
FIGS. 3A and 3B are graphs showing mouse Stat3 mRNA expression 3 days after treatment with GalXC-STAT3-C18 conjugates in G-MDSCs and M-MDSCs derived from Pan02 xenografts implanted in mice. Tumors were dosed at 25 mg/kg (FIG. 3A) and 50 mg/kg (FIG. 3B).
Figure 3B:
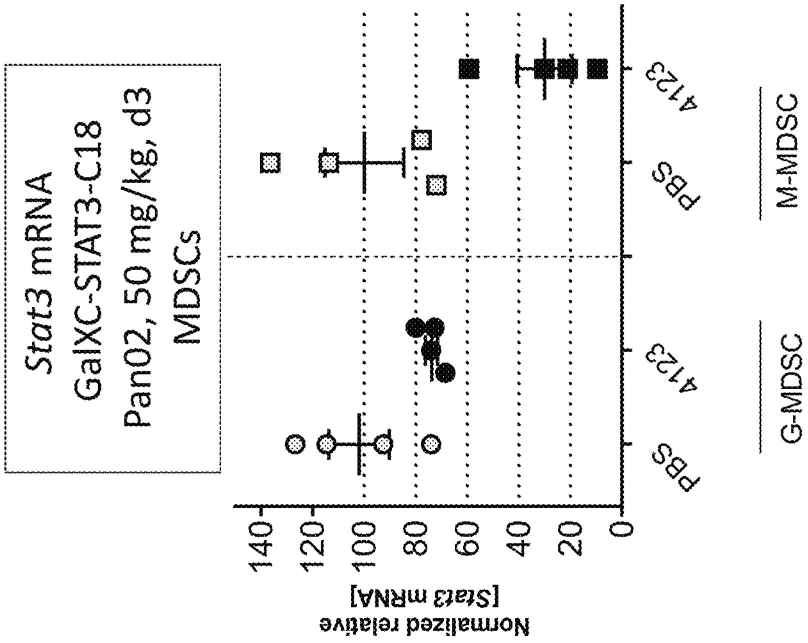
Figure 4A:
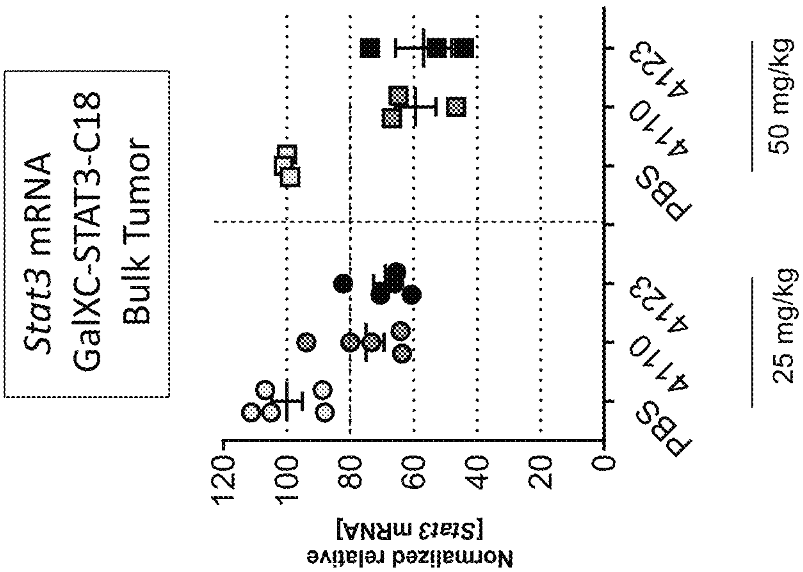
FIGS. 4A and 4B are graphs showing mouse Stat3 mRNA expression after treatment of Pan02 xenograft mice with GalXC-STAT3-C18 conjugates in bulk tumor (TME) (FIG. 4A) and tumor draining lymph nodes TdLNs (FIG. 4B) at doses of 25 and 50 mg/kg.
Figure 4B:
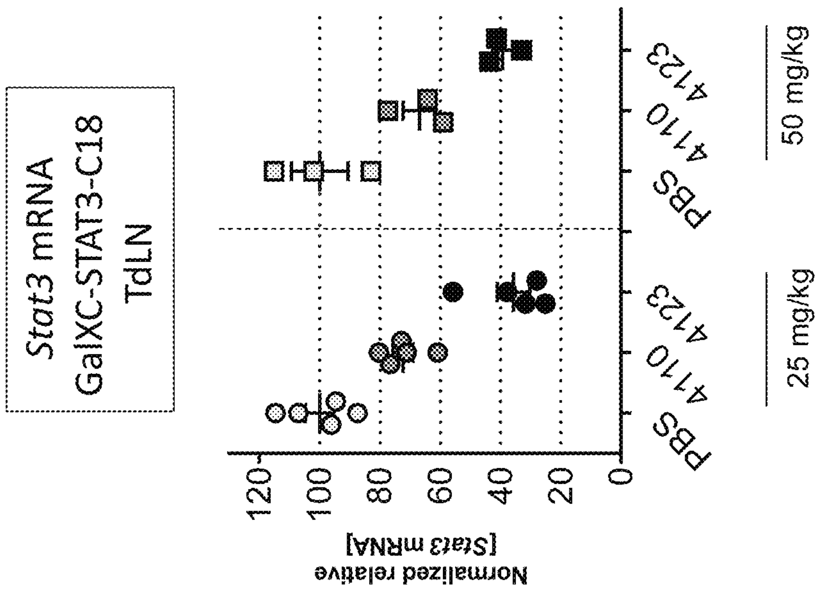

To evaluate the performance of GalXC-STAT3-C18 conjugates, Pan02 tumors were implanted in nude mice and upon reaching sufficient tumor volume mice were subjected to randomization as previously described. Mice received either a single dose of GalXC-STAT3-C18 4110 and 4123 subcutaneously at 25 mg/kg, 50 mg/kg, or PBS. At 3 days post injection, bulk tumors were collected and MDSC subsets were isolated. Collectively, MDSCs are characterized by the co-expression of cell surface or mRNA markers CD11b (a marker for the myeloid cells of the macrophage lineage) and Gr-1 (a marker for the myeloid lineage differentiation antigen) and denoted as $CD11b^+Gr\text{-}1^+$ cells. Gr-1 is further comprised of 2 components Ly6G and Ly6C. MDSCs consist of two subsets: Granulocytic MDSC (G-MDSC), further characterized as $CD11b^+Ly6G^+Ly6C^{lo}$, and monocytic MDSC (M-MDSC) characterized as $CD11b^+Ly6G^-Ly6C^{hi}$. To isolate the CD11b positive cells, a single cell suspension of tumor was made using gentle MACS dissociator. CD11b positive cells in the single cell suspension were then magnetically labeled with MACS microbeads and enriched by passing through MACS columns and subsequently eluting the retained labeled cells in the column as positively selected fractions (CD11b MicroBeads UltraPure, mouse kit Cat #130-126-725). For tumor cell separation, non-target cells in the cell suspension were magnetically labeled with a cocktail of microbeads and passed through the MACS columns. During this process, the unwanted labeled cells were retained in the column and the unlabeled target cells (tumor cells) were collected in the flow-through as pure fraction. (Tumor Cell Isolation Kit, human Cat #130-108-339). Following cell isolation mRNA was analyzed by qPCR (FIGS. 3A and 3B). Stat3 mRNA levels were reduced by ~40% in G-MDSC and M-MDSCs by GalXC-STAT3-C18-4123. GalXC-STAT3-C18-4110 reduced the Stat3 mRNA levels only by 20% in both MDSC subsets. To understand how the dose level of GalXC-STAT3-C18 conjugates plays a role in trafficking of these molecules to different tissues and cell subsets, a follow-up study was performed as previously described with the same tumor model. Pan02 tumor bearing mice were treated with a single subcutaneous dose of either GalXC-STAT3-C18-4123 at 50 mg/kg, or PBS and Stat3 mRNA levels were measured after 3 days. The Stat3 knockdown in G-MDSC was not significantly altered as compared to the knockdown observed at the 25 mg/kg dose, however there was a significant improvement in Stat3 silencing observed in M-MDSC subset at this same dose level. In parallel study performed as previously described, Stat3 knockdown was assessed in bulk tumors and TdLNs on day 7 (FIGS. 4A and 4B). Dose dependent Stat3 mRNA knockdown was observed in bulk tumor with both GalXC-STAT3-C18 sequences. In TdLNs Stat3 mRNA levels were reduced by ~60-65% by GalXC-STAT3-C18-4123, ~25-30% by GalXC-STAT3-C18-4110 at both doses suggesting a saturation effect at these dose levels. Based on the data, GalXC-STAT3-C18-4123 was selected for further efficacy evaluations in immunocompetent mice.

Figure 5A:
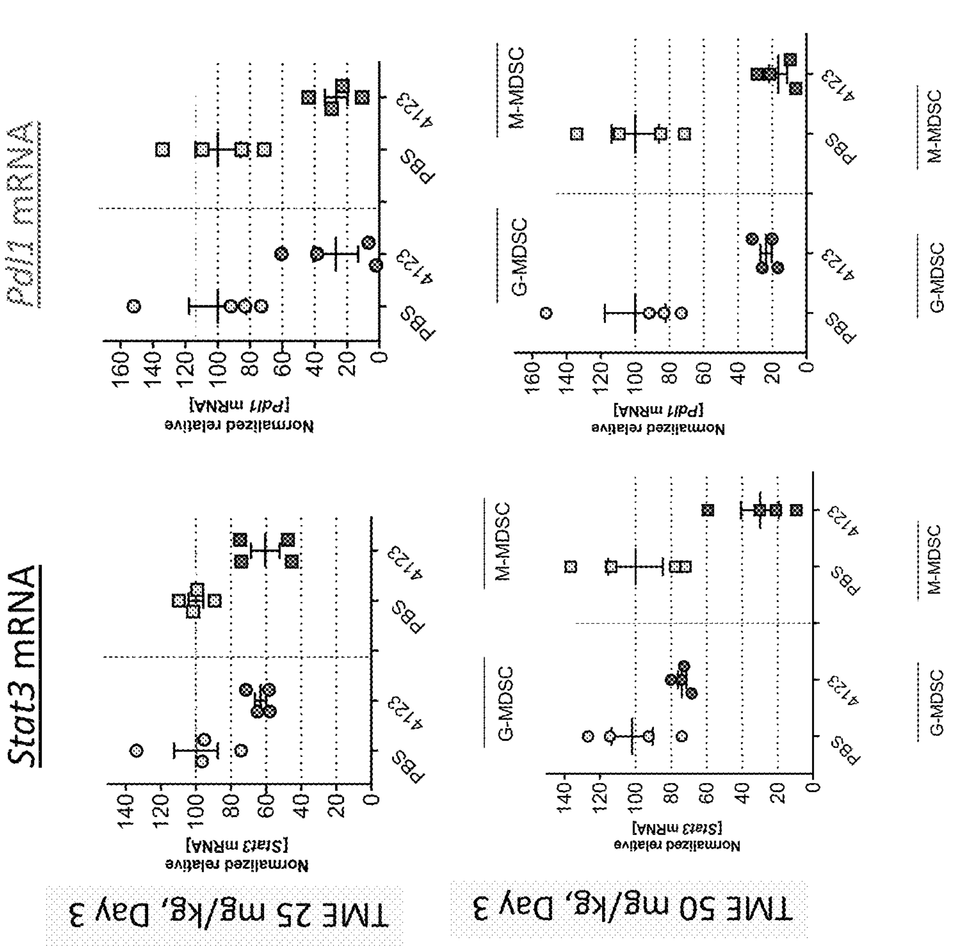
FIG. 5A provides graphs showing the effect of GalXC-STAT3-C18-4123 on Stat3 and Pdl1 mRNA levels in G/M-MDSCs in TME and TdLNs of Pan02 xenograft mice on 3 days after a dose of 25 or 50 mg/kg of the conjugated oligonucleotide.
Figure 5B:
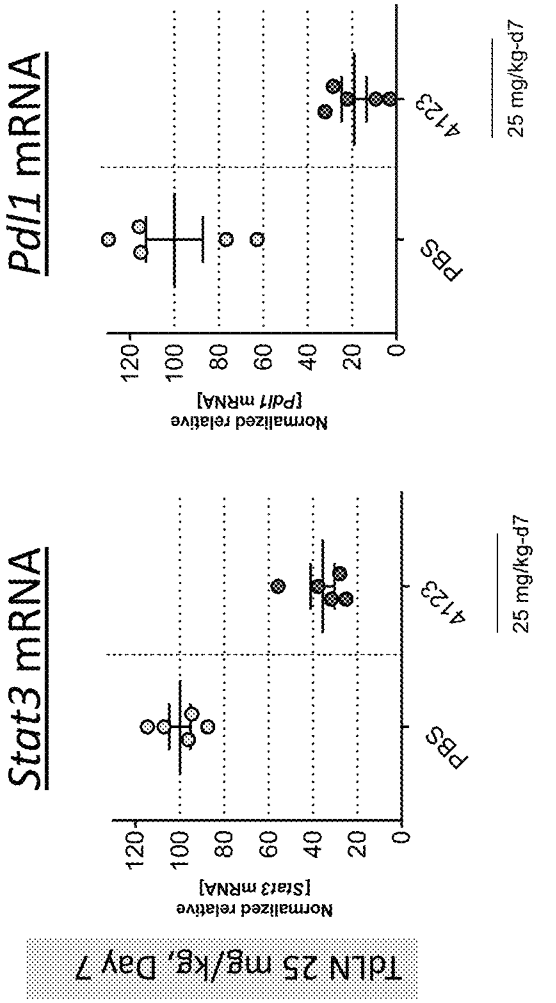
FIG. 5B provides graphs showing the effect of GalXC-STAT3-C18-4123 on Stat3 and Pdl1 mRNA levels in TdLN of Pan02 xenograft mice 7 days after a 25 mg/kg dose of the conjugated oligonucleotide.

Example 4: STAT3 Inhibition Decreases the PD-L1 Levels in MDSCs and Mediates Acute Tumor Effects The transcriptional signature of phosphorylated STAT3 has been positively correlated with PD-L1 expression in tumors (Song et al, Journal of Cell Physiology (2020), Zerdes et al, Cancers (2019), Song et al, Blood (2018). To extrapolate this correlation to STAT3 expressed by MDSCs, isolated populations of MDSCs treated with either PBS or a GalXC-STAT3 conjugate were assayed for Pdl1 mRNA. Pdl1 mRNA levels were decreased by ~80% in both G-MDSC and M-MDSC populations treated with either 25 or 50 mg/kg of a GalXC-STAT3 (FIG. 5A). The Pdl1 levels were also dramatically reduced in TdLN after treatment with the GalXC-STAT3 conjugate, specifically GalXC-STAT3-C18-4123 (FIG. 5B). These data suggest a potential for downstream immunomodulation of PD-L1 after knockdown of STAT3.

Figure 6A:
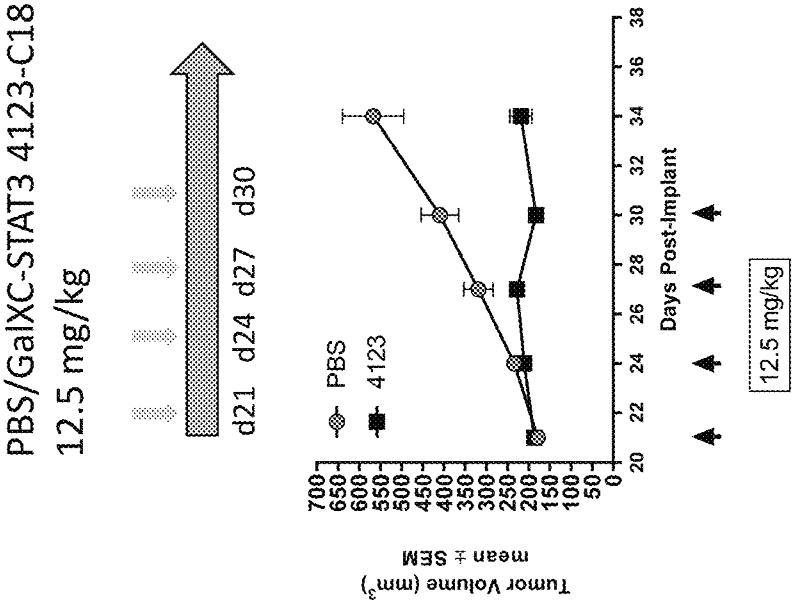
FIGS. 6A and 6B are graphs showing the in vivo effect of subcutaneous treatment of a total dose of 50 mg/kg GalXC-STAT3-C18-4123 on tumor volume over time in immunocompetent mice bearing Pan02 murine pancreatic tumors. Mice were treated with either four 12.5 mg/kg (FIG. 6A) or two 25 mg/kg (FIG. 6B) doses of the conjugated oligonucleotide. Lines show the average of all animals tested.
Figure 6B:
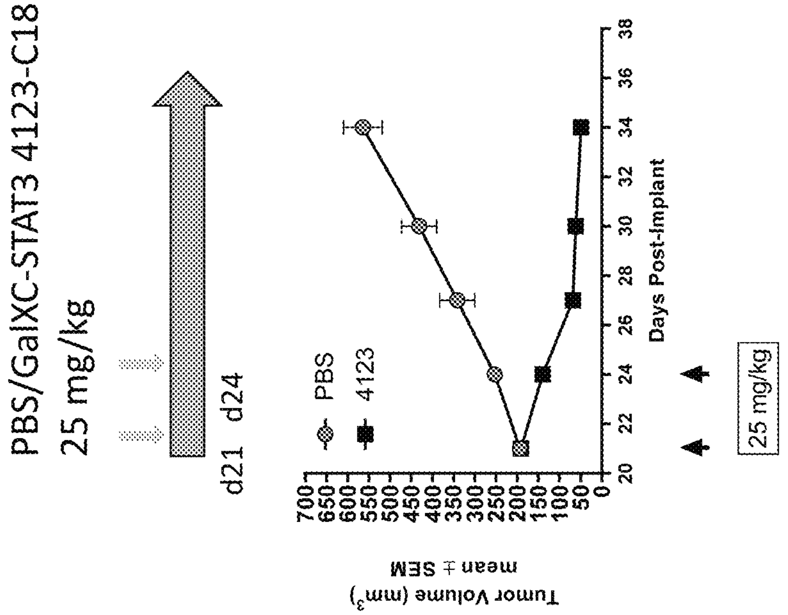

In a separate study, a Pan02 (murine pancreatic syngeneic model) tumor bearing C57BL/6 mice (n=4 per group) were treated subcutaneously with GalXC-STAT3-C18 conjugate following a split dosing model where all animals received a total dose of 50 mg/kg, dosed as either 25 mg/kg×2 doses or 12.5 mg/kg×4 doses. Tumors treated using the 25 mg/kg split dose showed acute tumor regression, even after the first dose (FIG. 6B). After the second dose of 25 mg/kg, tumors from 3 out of 4 mice regressed to sizes that were too small to be collected for further processing. The anti-tumor effect of the GalXC-STAT3 treatment was also observed in mice that received the 12.5 mg/kg split doses (FIG. 6A). These data suggest that STAT3 mediated regulation of PD-L1 results in an acute and dramatic effect on tumor growth in the Pan02 tumor bearing immunocompetent mice.

Example 5: Preparation of Double-Stranded RNAi Oligonucleotides

Oligonucleotide Synthesis and Purification

The double-stranded RNAi (dsRNA) oligonucleotides described in the foregoing Examples were chemically synthesized using methods described herein. Generally, dsRNAi oligonucleotides were synthesized using solid phase oligonucleotide synthesis methods as described for 19-23mer siRNAs (see, e.g., Scaringe et al. (1990) *Nucleic Acids Res.* 18:5433-5441 and Usman et al. (1987) *J. Am. Chem. Soc.* 109:7845-7845; see also, U.S. Pat. Nos. 5,804,683; 5,831,071; 5,998,203; 6,008,400; 6,111,086; 6,117,657; 6,353,098; 6,362,323; 6,437,117 and 6,469,158) in addition to using known phosphoramidite synthesis (see, e.g. Hughes and Ellington (2017) *Cold Spring Harb Perspect Biol.* 9(1):a023812; Beaucage S. L., Caruthers M. H. Studies on Nucleotide Chemistry V: Deoxynucleoside Phosphoramidites—A New Class of Key Intermediates for Deoxypolynucleotide Synthesis. Tetrahedron Lett. 1981; 22:1859-1862. doi: 10.1016/S0040-4039 (01) 90461-7). dsRNAi oligonucleotides having a 19mer core sequence were formatted into constructs having a 25mer sense strand and a 27mer antisense strand to allow for processing by the RNAi machinery. The 19mer core sequence is complementary to a region in the STAT3 mRNA.

Individual RNA strands were synthesized and HPLC purified according to standard methods (Integrated DNA Technologies; Coralville, IA). For example, RNA oligonucleotides were synthesized using solid phase phosphoramidite chemistry, deprotected and desalted on NAP-5 columns (Amersham Pharmacia Biotech; Piscataway, NJ) using standard techniques (Damha & Olgivie (1993) *Methods Mol. Biol.* 20:81-114; Wincott et al. (1995) *Nucleic Acids Res.* 23:2677-2684). The oligomers were purified using ion-exchange high performance liquid chromatography (IE-HPLC) on an Amersham Source 15Q column (1.0 cm×25 cm; Amersham Pharmacia Biotech) using a 15 min step-linear gradient. The gradient varied from 90:10 Buffers A: B to 52:48 Buffers A: B, where Buffer A is 100 mM Tris pH 8.5 and Buffer B is 100 mM Tris pH 8.5, 1 M NaCl. Samples were monitored at 260 nm and peaks corresponding to the full-length oligonucleotide species were collected, pooled, desalted on NAP-5 columns, and lyophilized.

The purity of each oligomer was determined by capillary electrophoresis (CE) on a Beckman PACE 5000 (Beckman Coulter, Inc.; Fullerton, CA). The CE capillaries have a 100 μm inner diameter and contain ssDNA 100R Gel (Beckman-Coulter). Typically, about 0.6 nmole of oligonucleotide was injected into a capillary, run in an electric field of 444 V/cm and was detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems; Foster City, CA) following the manufacturer's recommended protocol. Relative molecular masses of all oligomers were obtained, often within 0.2% of expected molecular mass.

Preparation of Duplexes

Single strand RNA oligomers were resuspended (e.g., at 100 μM concentration) in duplex buffer consisting of 100 mM potassium acetate, 30 mM HEPES, pH 7.5. Complementary sense and antisense strands were mixed in equal molar amounts to yield a final solution of, for example, 50 μM duplex. Samples were heated to 100° C. for 5' in RNA buffer (IDT) and were allowed to cool to room temperature before use. The dsRNA oligonucleotides were stored at −20° C. Single strand RNA oligomers were stored lyophilized or in nuclease-free water at −80° C.

Example 6: Generation of STAT3-Targeting Double-Stranded RNAi Oligonucleotides

Identification of STAT3 mRNA Target Sequences

Signal transducer and activator of transcription 3 (STAT3) is a transcription factor involved in several development and disease functions. To generate RNAi oligonucleotide inhibitors of STAT3 expression, a computer-based algorithm was used to computationally identify STAT3 mRNA target sequences suitable for assaying inhibition of STAT3 expression by the RNAi pathway. The algorithm provided RNAi oligonucleotide guide (antisense) strand sequences each having a region of complementarity to a suitable STAT3 target sequence of human STAT3 mRNA (e.g., SEQ ID NO:1217; Table 4). Some of the guide strand sequences identified by the algorithm were also complementary to the corresponding STAT3 target sequence of monkey STAT3 mRNA (SEQ ID NO: 1218 Table 4) and/or mouse STAT3 mRNA. STAT3 RNAi oligonucleotides comprising a region of complementarity to homologous STAT3 mRNA target sequences with nucleotide sequence similarity are predicted to have the ability to target homologous STAT3 mRNAs.

TABLE 4

Sequences of Human and Monkey STAT3 mRNA

| Species | Ref Seq # | SEQ ID NO |
|---|---|---|
| Human (Hs) | NM_139276.3 | 1217 |
| *M. Fascicularis* (Mf) | XM_005584240.2 | 1218 |
| *Mus Musculus* (Mm) | NM_213659.3 | 8 |

RNAi oligonucleotides (formatted as DsiRNA oligonucleotides) were generated as described in Example 5 for evaluation in vitro. Each DsiRNA was generated with the same modification pattern, and each with a unique guide strand having a region of complementarity to a STAT3 target sequence identified by SEQ ID NOs: 89-280. Modifications for the sense and anti-sense DsiRNA included the following (X-any nucleotide; m-2'-O-methyl modified nucleotide; r-ribosyl modified nucleotide):

Sense Strand:
*rXmXrXmXrXrXrXrXrXrXrXrXrXmXrXmXrXrXrXrXrXrXrXXX*

Anti-sense Strand:
*mXmXmXmXrXrXrXrXrXrXmXrXmXrXrXrXrXrXrXrXrXrXrXmXr*

*XmXmXmX*

Figure 7:
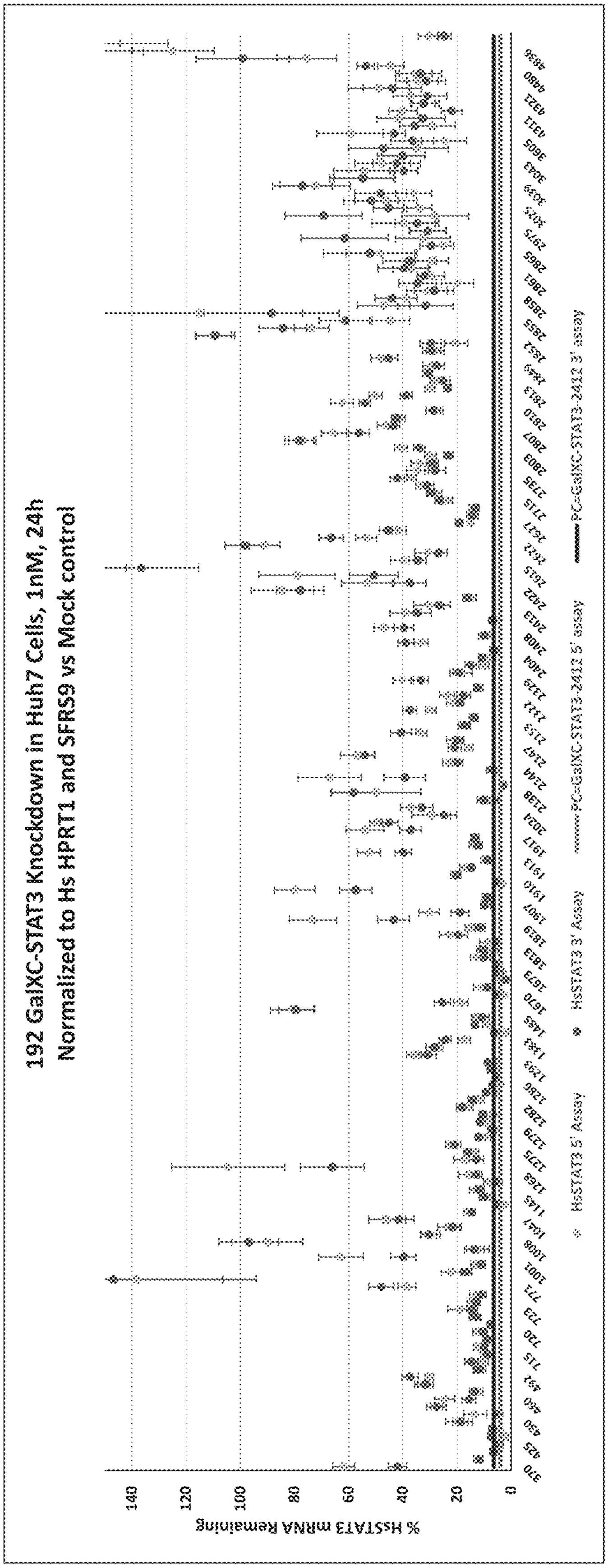
FIG. 7 provides a graph depicting the percent (%) of human STAT3 mRNA remaining in Huh7 cells endogenously expressing human STAT3, after 24-hour treatment with 1 nM of DsiRNA targeting various regions of the STAT3 gene. 192 DsiRNAs were designed and screened. Two primer pairs were used. Expression was normalized between samples using the HPRT and SFRS9 housekeeping genes (Forward 1—SEQ ID NO: 1219, Reverse 1—SEQ ID NO: 1220; Probe 1—SEQ ID NO: 1221; Forward 2—SEQ ID NO: 1, Reverse 2—SEQ ID NO: 2; Probe 2—SEQ ID NO: 3).

The ability of each of the modified DsiRNA in Table 5 to reduce STAT3 mRNA was measured using in vitro cell-based assays. Briefly, human hepatocyte (Huh7) cells expressing endogenous human STAT3 gene were transfected with each of the DsiRNAs listed in Table 5 at 1 nM in separate wells of a multi-well cell-culture plate. Cells were maintained for 24 hours following transfection with the modified DsiRNA, and then the amount of remaining STAT3 mRNA from the transfected cells was determined using TAQMAN®-based qPCR assays. Two qPCR assays, a 3' assay and 5' assay (Forward 1—SEQ ID NO:1219), Reverse 1—SEQ ID NO: 1220, Probe 1—SEQ ID NO: 1221; Forward 2—SEQ ID NO: 1, Reverse 2—SEQ ID NO: 2, Probe 2—SEQ ID NO: 3) were used to determine STAT3 mRNA levels as measured using PCR probes conjugated to 6-carboxy-fluorescein (FAM). Each primer pair was assayed for % remaining RNA as shown in Table 5 and FIG. 7. DsiRNAs resulting in less than or equal to 10% STAT3 mRNA remaining in DsiRNA-transfected cells when compared to mock-transfected cells were considered DsiRNA "hits". The Huh7 cell-based assay evaluating the ability of the DsiRNAs listed in Table 5 to inhibit STAT3 expression identified several candidate DsiRNAs. Taken together, these results show that DsiRNAs designed to target human STAT3 mRNA inhibit STAT3 expression in cells, as determined by a reduced amount of STAT3 mRNA in DsiRNA-transfected cells relative to control cells. These results demonstrate that the nucleotide sequences comprising the DsiRNA are useful for generating RNAi oligonucleotides to inhibit STAT3 expression. Further, these results demonstrate that multiple STAT3 mRNA target sequences are suitable for the RNAi-mediated inhibition of STAT3 expression.

TABLE 5

Analysis of STAT3 mRNA in Huh7 cells

| SED ID NO (Sense Strand) | SED ID NO (Anti-sense Strand) | DsiRNA name | Average % remaining | Average SEM | STAT3-5' Assay % remaining | STAT3-5' Assay SEM | STAT3-3' Assay % remaining | STAT3-3' Assay SEM |
|---|---|---|---|---|---|---|---|---|
| 473 | 665 | 370 | 51.9 | 3.7 | 61.8 | 4.0 | 41.9 | 3.3 |
| 474 | 666 | 372 | 12.0 | 1.3 | 12.3 | 1.5 | 11.7 | 1.2 |
| 475 | 667 | 424 | 5.9 | 1.5 | 5.3 | 1.7 | 6.5 | 1.2 |
| 476 | 668 | 425 | 4.4 | 1.0 | 4.7 | 0.8 | 4.2 | 1.2 |
| 477 | 669 | 426 | 4.6 | 1.2 | 2.1 | 1.0 | 7.2 | 1.5 |
| 478 | 670 | 429 | 5.5 | 1.0 | 4.2 | 0.6 | 6.9 | 1.3 |
| 479 | 671 | 430 | 19.0 | 3.9 | 19.3 | 5.0 | 18.7 | 2.7 |
| 480 | 672 | 432 | 8.8 | 2.5 | 13.3 | 4.2 | 4.4 | 0.8 |
| 481 | 673 | 433 | 27.6 | 2.9 | 27.6 | 3.6 | 27.5 | 2.2 |
| 482 | 674 | 460 | 20.1 | 3.1 | 24.5 | 3.7 | 15.6 | 2.5 |
| 483 | 675 | 461 | 12.9 | 1.9 | 12.4 | 2.0 | 13.5 | 1.9 |
| 484 | 676 | 462 | 32.2 | 2.9 | 32.7 | 2.9 | 31.6 | 2.9 |
| 485 | 677 | 492 | 33.8 | 2.3 | 30.3 | 1.6 | 37.3 | 3.0 |
| 486 | 678 | 678 | 11.7 | 2.0 | 11.7 | 2.3 | 11.8 | 1.6 |
| 487 | 679 | 681 | 12.5 | 2.3 | 10.4 | 2.0 | 14.6 | 2.5 |
| 488 | 680 | 715 | 9.5 | 0.8 | 10.4 | 0.9 | 8.7 | 0.7 |
| 489 | 681 | 716 | 11.2 | 1.1 | 12.5 | 1.4 | 9.9 | 0.7 |
| 490 | 682 | 717 | 8.4 | 1.5 | 8.0 | 1.4 | 8.7 | 1.6 |
| 491 | 683 | 720 | 11.4 | 1.7 | 12.4 | 1.8 | 10.4 | 1.5 |
| 492 | 684 | 721 | 7.5 | 0.9 | 7.3 | 0.8 | 7.6 | 0.9 |
| 493 | 685 | 722 | 13.3 | 2.0 | 13.5 | 2.1 | 13.1 | 2.0 |
| 494 | 686 | 723 | 16.7 | 3.2 | 18.9 | 4.5 | 14.4 | 1.9 |
| 495 | 687 | 724 | 13.6 | 1.7 | 14.2 | 2.0 | 12.9 | 1.5 |
| 496 | 688 | 768 | 12.1 | 2.0 | 13.1 | 2.2 | 11.0 | 1.8 |
| 497 | 689 | 771 | 43.2 | 3.9 | 38.4 | 3.3 | 48.0 | 4.6 |
| 498 | 690 | 773 | 142.6 | 42.3 | 138.3 | 44.1 | 146.9 | 40.4 |
| 499 | 691 | 1000 | 19.3 | 2.9 | 22.0 | 3.9 | 16.5 | 2.0 |
| 500 | 692 | 1001 | 12.1 | 1.6 | 13.3 | 1.7 | 11.0 | 1.4 |
| 501 | 693 | 1003 | 51.3 | 6.5 | 62.8 | 8.3 | 39.8 | 4.7 |
| 502 | 694 | 1006 | 13.0 | 3.9 | 12.3 | 4.2 | 13.6 | 3.7 |
| 503 | 695 | 1008 | 93.5 | 12.0 | 90.0 | 13.1 | 96.9 | 11.0 |
| 504 | 696 | 1009 | 30.1 | 3.2 | 29.9 | 3.7 | 30.4 | 2.8 |
| 505 | 697 | 1010 | 22.1 | 3.5 | 22.7 | 4.4 | 21.5 | 2.6 |
| 506 | 698 | 1047 | 43.7 | 6.3 | 45.8 | 6.8 | 41.6 | 5.7 |
| 507 | 699 | 1067 | 15.3 | 1.3 | 16.0 | 1.5 | 14.5 | 1.1 |
| 508 | 700 | 1068 | 3.6 | 0.7 | 2.5 | 0.8 | 4.8 | 0.7 |
| 509 | 701 | 1145 | 9.2 | 2.2 | 8.4 | 2.5 | 9.9 | 1.8 |
| 510 | 702 | 1151 | 12.4 | 2.1 | 13.0 | 2.4 | 11.9 | 1.9 |
| 511 | 703 | 1241 | 6.7 | 1.9 | 8.3 | 1.9 | 5.1 | 1.8 |
| 512 | 704 | 1268 | 14.3 | 3.0 | 15.6 | 3.8 | 13.0 | 2.2 |
| 513 | 705 | 1272 | 85.2 | 16.3 | 104.4 | 20.9 | 66.1 | 11.8 |
| 514 | 706 | 1273 | 15.1 | 3.3 | 17.3 | 3.9 | 12.8 | 2.7 |
| 515 | 707 | 1275 | 14.7 | 1.7 | 13.7 | 1.8 | 15.8 | 1.7 |
| 516 | 708 | 1277 | 21.7 | 2.0 | 22.5 | 1.7 | 20.9 | 2.3 |
| 517 | 709 | 1278 | 10.8 | 1.4 | 9.4 | 1.9 | 12.1 | 0.9 |

TABLE 5-continued

Analysis of STAT3 mRNA in Huh7 cells

| SED ID NO (Sense Strand) | SED ID NO (Anti-sense Strand) | DsiRNA name | Average % remaining | Average SEM | STAT3-5' Assay % remaining | STAT3-5' Assay SEM | STAT3-3' Assay % remaining | STAT3-3' Assay SEM |
|---|---|---|---|---|---|---|---|---|
| 518 | 710 | 1279 | 6.8 | 0.7 | 6.3 | 0.7 | 7.3 | 0.8 |
| 519 | 711 | 1280 | 9.9 | 1.0 | 8.2 | 1.0 | 11.5 | 1.0 |
| 520 | 712 | 1281 | 8.6 | 1.1 | 6.7 | 0.9 | 10.5 | 1.4 |
| 521 | 713 | 1282 | 17.0 | 1.9 | 15.8 | 1.6 | 18.1 | 2.1 |
| 522 | 714 | 1283 | 12.8 | 1.5 | 11.3 | 1.4 | 14.2 | 1.7 |
| 523 | 715 | 1284 | 7.8 | 1.0 | 6.2 | 0.8 | 9.4 | 1.3 |
| 524 | 716 | 1286 | 5.5 | 0.4 | 3.9 | 0.5 | 7.0 | 0.4 |
| 525 | 717 | 1287 | 5.1 | 0.6 | 4.6 | 0.9 | 5.6 | 0.3 |
| 526 | 718 | 1292 | 6.4 | 0.8 | 5.3 | 0.6 | 7.6 | 1.1 |
| 527 | 719 | 1293 | 7.3 | 0.8 | 5.9 | 0.9 | 8.7 | 0.6 |
| 528 | 720 | 1299 | 33.4 | 3.0 | 35.8 | 2.7 | 30.9 | 3.2 |
| 529 | 721 | 1305 | 27.5 | 1.9 | 26.7 | 0.6 | 28.3 | 3.1 |
| 530 | 722 | 1383 | 20.8 | 2.2 | 17.4 | 2.3 | 24.3 | 2.1 |
| 531 | 723 | 1388 | 4.0 | 0.8 | 1.6 | 0.6 | 6.3 | 0.9 |
| 532 | 724 | 1427 | 11.0 | 1.5 | 8.6 | 2.0 | 13.3 | 1.0 |
| 533 | 725 | 1485 | 11.6 | 2.3 | 12.4 | 2.1 | 10.8 | 2.6 |
| 534 | 726 | 1584 | 80.0 | 7.3 | 80.7 | 8.2 | 79.4 | 6.5 |
| 535 | 727 | 1586 | 22.0 | 2.8 | 18.6 | 2.6 | 25.4 | 3.0 |
| 536 | 728 | 1670 | 4.0 | 0.5 | 2.6 | 0.4 | 5.4 | 0.6 |
| 537 | 729 | 1671 | 9.9 | 2.6 | 10.8 | 3.1 | 8.9 | 2.1 |
| 538 | 730 | 1672 | 2.8 | 0.8 | 3.6 | 1.2 | 2.1 | 0.5 |
| 539 | 731 | 1673 | 3.7 | 0.9 | 3.1 | 1.0 | 4.2 | 0.9 |
| 540 | 732 | 1674 | 5.2 | 1.5 | 5.0 | 1.7 | 5.4 | 1.3 |
| 541 | 733 | 1676 | 11.5 | 2.3 | 13.0 | 2.1 | 10.1 | 2.4 |
| 542 | 734 | 1813 | 8.8 | 2.1 | 6.9 | 2.2 | 10.7 | 2.0 |
| 543 | 735 | 1815 | 7.0 | 1.9 | 8.9 | 2.7 | 5.0 | 1.1 |
| 544 | 736 | 1817 | 21.2 | 3.5 | 22.8 | 3.6 | 19.6 | 3.5 |
| 545 | 737 | 1819 | 13.3 | 1.9 | 15.0 | 1.9 | 11.5 | 1.8 |
| 546 | 738 | 1904 | 58.3 | 7.3 | 73.2 | 8.7 | 43.4 | 5.9 |
| 547 | 739 | 1906 | 24.6 | 3.5 | 30.2 | 3.8 | 18.9 | 3.2 |
| 548 | 740 | 1907 | 9.7 | 1.4 | 9.4 | 1.9 | 9.9 | 0.9 |
| 549 | 741 | 1908 | 9.0 | 1.4 | 9.2 | 1.5 | 8.9 | 1.3 |
| 550 | 742 | 1909 | 68.6 | 6.7 | 79.9 | 7.5 | 57.4 | 6.0 |
| 551 | 743 | 1910 | 4.3 | 0.6 | 3.3 | 0.6 | 5.4 | 0.6 |
| 552 | 744 | 1911 | 20.4 | 1.6 | 20.6 | 1.7 | 20.2 | 1.6 |
| 553 | 745 | 1912 | 15.6 | 1.6 | 16.6 | 2.4 | 14.7 | 0.8 |
| 554 | 746 | 1913 | 9.4 | 1.0 | 10.1 | 0.9 | 8.8 | 1.1 |
| 555 | 747 | 1914 | 46.2 | 3.6 | 52.5 | 4.2 | 39.8 | 3.0 |
| 556 | 748 | 1916 | 12.9 | 2.0 | 13.3 | 2.2 | 12.4 | 1.7 |
| 557 | 749 | 1917 | 13.3 | 1.4 | 13.4 | 1.5 | 13.3 | 1.3 |
| 558 | 750 | 1919 | 45.6 | 5.5 | 54.0 | 7.0 | 37.1 | 4.0 |
| 559 | 751 | 1920 | 47.5 | 2.8 | 49.9 | 2.3 | 45.1 | 3.4 |
| 560 | 752 | 2024 | 27.1 | 5.9 | 29.5 | 7.1 | 24.7 | 4.6 |
| 561 | 753 | 2135 | 35.1 | 3.7 | 37.4 | 3.4 | 32.8 | 3.9 |
| 562 | 754 | 2136 | 8.6 | 2.1 | 6.9 | 2.0 | 10.3 | 2.2 |
| 563 | 755 | 2138 | 54.0 | 12.5 | 49.8 | 16.5 | 58.1 | 8.5 |
| 564 | 756 | 2139 | 2.9 | 0.6 | 2.8 | 0.7 | 3.1 | 0.6 |
| 565 | 757 | 2143 | 53.2 | 9.7 | 67.0 | 11.8 | 39.3 | 7.7 |
| 566 | 758 | 2144 | 6.2 | 1.6 | 5.1 | 1.3 | 7.2 | 1.9 |
| 567 | 759 | 2145 | 21.4 | 2.1 | 23.1 | 2.2 | 19.8 | 2.0 |
| 568 | 760 | 2146 | 55.3 | 5.0 | 56.7 | 6.3 | 54.0 | 3.7 |
| 569 | 761 | 2147 | 18.2 | 1.9 | 15.6 | 1.4 | 20.8 | 2.4 |
| 570 | 762 | 2148 | 20.2 | 2.5 | 20.7 | 3.1 | 19.8 | 1.9 |
| 571 | 763 | 2151 | 36.9 | 3.0 | 33.2 | 2.0 | 40.7 | 3.9 |
| 572 | 764 | 2153 | 17.1 | 1.9 | 17.3 | 2.2 | 17.0 | 1.6 |
| 573 | 765 | 2154 | 13.7 | 1.3 | 13.9 | 1.6 | 13.6 | 0.9 |
| 574 | 766 | 2159 | 33.6 | 2.2 | 29.7 | 1.9 | 37.5 | 2.6 |
| 575 | 767 | 2322 | 20.1 | 1.8 | 21.3 | 2.5 | 18.8 | 1.2 |
| 576 | 768 | 2325 | 20.6 | 2.6 | 23.7 | 2.7 | 17.5 | 2.5 |
| 577 | 769 | 2327 | 12.1 | 1.4 | 11.8 | 1.4 | 12.4 | 1.4 |
| 578 | 770 | 2329 | 36.8 | 3.0 | 40.3 | 3.3 | 33.4 | 2.8 |
| 579 | 771 | 2333 | 18.9 | 3.1 | 18.5 | 4.2 | 19.4 | 2.0 |
| 580 | 772 | 2335 | 12.5 | 1.9 | 10.1 | 1.8 | 14.9 | 2.1 |
| 581 | 773 | 2404 | 9.8 | 2.2 | 8.7 | 3.0 | 10.8 | 1.3 |
| 582 | 774 | 2405 | 6.1 | 1.3 | 5.9 | 1.1 | 6.4 | 1.4 |
| 583 | 775 | 2407 | 36.0 | 2.7 | 33.2 | 2.6 | 38.9 | 2.9 |
| 584 | 776 | 2408 | 9.3 | 2.0 | 8.6 | 1.9 | 10.0 | 2.0 |
| 585 | 777 | 2411 | 43.2 | 3.7 | 46.9 | 3.7 | 39.6 | 3.6 |
| 586 | 778 | 2412 | 6.1 | 1.2 | 5.3 | 1.4 | 7.0 | 1.0 |
| 587 | 779 | 2413 | 36.9 | 5.5 | 39.0 | 5.8 | 34.8 | 5.3 |
| 588 | 780 | 2416 | 28.6 | 4.9 | 30.4 | 5.6 | 26.7 | 4.2 |

TABLE 5-continued

Analysis of STAT3 mRNA in Huh7 cells

| SED ID NO (Sense Strand) | SED ID NO (Anti-sense Strand) | DsiRNA name | Average % remaining | Average SEM | STAT3-5' Assay % remaining | STAT3-5' Assay SEM | STAT3-3' Assay % remaining | STAT3-3' Assay SEM |
|---|---|---|---|---|---|---|---|---|
| 589 | 781 | 2418 | 15.5 | 1.9 | 15.0 | 2.1 | 16.0 | 1.7 |
| 590 | 782 | 2422 | 81.2 | 10.1 | 84.5 | 11.5 | 77.9 | 8.8 |
| 591 | 783 | 2427 | 45.3 | 7.7 | 53.2 | 9.4 | 37.3 | 5.9 |
| 592 | 784 | 2612 | 64.9 | 11.5 | 79.1 | 14.0 | 50.6 | 9.0 |
| 593 | 785 | 2615 | 153.3 | 24.5 | 170.0 | 27.8 | 136.6 | 21.1 |
| 594 | 786 | 2616 | 37.3 | 3.8 | 40.0 | 4.5 | 34.5 | 3.1 |
| 595 | 787 | 2617 | 28.9 | 4.1 | 30.8 | 4.8 | 27.0 | 3.3 |
| 596 | 788 | 2622 | 94.8 | 6.4 | 91.1 | 5.7 | 98.5 | 7.1 |
| 597 | 789 | 2625 | 60.0 | 4.2 | 53.6 | 3.9 | 66.4 | 4.4 |
| 598 | 790 | 2626 | 43.4 | 2.9 | 41.3 | 2.6 | 45.5 | 3.1 |
| 599 | 791 | 2627 | 17.1 | 1.0 | 15.0 | 0.6 | 19.2 | 1.4 |
| 600 | 792 | 2692 | 14.2 | 1.9 | 14.0 | 1.6 | 14.3 | 2.1 |
| 601 | 793 | 2693 | 13.6 | 1.4 | 14.0 | 1.4 | 13.2 | 1.5 |
| 602 | 794 | 2715 | 24.9 | 1.8 | 23.5 | 1.9 | 26.2 | 1.8 |
| 603 | 795 | 2719 | 28.7 | 2.3 | 28.2 | 2.6 | 29.3 | 2.0 |
| 604 | 796 | 2721 | 32.2 | 2.3 | 33.2 | 2.0 | 31.1 | 2.6 |
| 605 | 797 | 2735 | 39.4 | 2.2 | 36.7 | 1.7 | 42.0 | 2.6 |
| 606 | 798 | 2741 | 31.3 | 3.9 | 34.6 | 4.1 | 28.1 | 3.8 |
| 607 | 799 | 2801 | 31.4 | 2.7 | 33.7 | 3.3 | 29.0 | 2.1 |
| 608 | 800 | 2803 | 26.5 | 1.9 | 29.8 | 2.1 | 23.1 | 1.7 |
| 609 | 801 | 2804 | 37.3 | 2.2 | 40.7 | 2.4 | 33.9 | 2.1 |
| 610 | 802 | 2806 | 77.7 | 5.2 | 77.1 | 5.0 | 78.2 | 5.3 |
| 611 | 803 | 2807 | 60.9 | 4.2 | 65.4 | 4.7 | 56.3 | 3.8 |
| 612 | 804 | 2808 | 44.7 | 2.9 | 45.9 | 3.5 | 43.5 | 2.4 |
| 613 | 805 | 2809 | 41.7 | 1.9 | 41.0 | 1.9 | 42.3 | 1.8 |
| 614 | 806 | 2810 | 28.6 | 2.9 | 28.3 | 3.1 | 28.8 | 2.6 |
| 615 | 807 | 2811 | 58.2 | 3.1 | 62.4 | 4.1 | 54.0 | 2.1 |
| 616 | 808 | 2812 | 44.4 | 2.3 | 50.1 | 2.4 | 38.7 | 2.2 |
| 617 | 809 | 2813 | 26.7 | 1.6 | 30.0 | 1.8 | 23.5 | 1.3 |
| 618 | 810 | 2846 | 26.4 | 2.3 | 27.8 | 2.1 | 25.0 | 2.5 |
| 619 | 811 | 2848 | 30.9 | 1.4 | 31.3 | 1.4 | 30.5 | 1.5 |
| 620 | 812 | 2849 | 28.5 | 2.8 | 29.6 | 3.0 | 27.4 | 2.7 |
| 621 | 813 | 2850 | 46.7 | 3.4 | 48.2 | 3.5 | 45.2 | 3.4 |
| 622 | 814 | 2851 | 28.7 | 3.3 | 28.0 | 3.3 | 29.4 | 3.3 |
| 623 | 815 | 2852 | 25.0 | 4.1 | 20.3 | 4.2 | 29.8 | 3.9 |
| 624 | 816 | 2853 | 109.6 | 6.9 | 109.9 | 6.6 | 109.2 | 7.1 |
| 625 | 817 | 2854 | 79.0 | 7.6 | 73.6 | 6.4 | 84.3 | 8.7 |
| 626 | 818 | 2855 | 53.0 | 8.6 | 44.8 | 7.4 | 61.1 | 9.8 |
| 627 | 819 | 2856 | 101.8 | 31.5 | 115.1 | 38.1 | 88.4 | 24.9 |
| 628 | 820 | 2857 | 39.3 | 10.0 | 47.1 | 9.7 | 31.6 | 10.3 |
| 629 | 821 | 2858 | 41.4 | 5.1 | 38.8 | 4.0 | 44.0 | 6.2 |
| 630 | 822 | 2859 | 29.8 | 7.4 | 31.1 | 7.5 | 28.5 | 7.3 |
| 631 | 823 | 2860 | 27.2 | 6.4 | 19.8 | 5.9 | 34.6 | 6.9 |
| 632 | 824 | 2861 | 30.8 | 3.8 | 29.5 | 5.0 | 32.1 | 2.6 |
| 633 | 825 | 2862 | 38.3 | 8.0 | 37.1 | 6.5 | 39.6 | 9.6 |
| 634 | 826 | 2863 | 33.5 | 8.0 | 29.4 | 6.2 | 37.6 | 9.8 |
| 635 | 827 | 2865 | 50.2 | 15.0 | 48.2 | 12.7 | 52.1 | 17.2 |
| 636 | 828 | 2867 | 27.3 | 4.0 | 25.0 | 3.8 | 29.6 | 4.1 |
| 637 | 829 | 2868 | 47.0 | 13.0 | 32.6 | 10.1 | 61.4 | 16.0 |
| 638 | 830 | 2975 | 30.7 | 6.7 | 30.6 | 6.7 | 30.9 | 6.8 |
| 639 | 831 | 2979 | 37.2 | 9.9 | 39.7 | 11.8 | 34.8 | 8.1 |
| 640 | 832 | 2985 | 48.7 | 13.2 | 28.0 | 12.3 | 69.3 | 14.2 |
| 641 | 833 | 3025 | 39.6 | 5.1 | 33.9 | 4.6 | 45.3 | 5.6 |
| 642 | 834 | 3037 | 49.0 | 10.8 | 46.3 | 11.5 | 51.7 | 10.1 |
| 643 | 835 | 3038 | 42.1 | 8.1 | 36.0 | 6.6 | 48.2 | 9.6 |
| 644 | 836 | 3039 | 74.7 | 12.0 | 72.4 | 13.0 | 77.0 | 11.0 |
| 645 | 837 | 3041 | 54.7 | 11.6 | 54.4 | 11.0 | 54.9 | 12.1 |
| 646 | 838 | 3042 | 46.9 | 8.2 | 54.3 | 11.3 | 39.6 | 5.1 |
| 647 | 839 | 3043 | 44.9 | 9.5 | 47.5 | 10.3 | 42.2 | 8.8 |
| 648 | 840 | 3225 | 40.3 | 8.4 | 40.7 | 8.8 | 39.9 | 8.0 |
| 649 | 841 | 3226 | 41.0 | 12.2 | 34.7 | 11.5 | 47.2 | 12.9 |
| 650 | 842 | 3605 | 30.6 | 8.1 | 24.7 | 8.3 | 36.5 | 7.9 |
| 651 | 843 | 3611 | 51.3 | 8.2 | 59.5 | 12.2 | 43.1 | 4.1 |
| 652 | 844 | 3906 | 32.1 | 6.8 | 28.6 | 7.9 | 35.5 | 5.6 |
| 653 | 845 | 4311 | 37.2 | 8.0 | 41.7 | 7.8 | 32.6 | 8.2 |
| 654 | 846 | 4314 | 31.0 | 4.5 | 39.9 | 5.2 | 22.0 | 3.8 |
| 655 | 847 | 4317 | 32.1 | 4.8 | 31.9 | 5.3 | 32.3 | 4.3 |
| 656 | 848 | 4321 | 34.1 | 6.7 | 37.3 | 6.2 | 30.9 | 7.2 |
| 657 | 849 | 4465 | 46.3 | 11.0 | 48.9 | 11.3 | 43.8 | 10.8 |
| 658 | 850 | 4479 | 33.1 | 7.5 | 34.8 | 7.8 | 31.4 | 7.1 |
| 659 | 851 | 4480 | 34.7 | 7.3 | 36.0 | 6.7 | 33.5 | 7.9 |

TABLE 5-continued

| Analysis of STAT3 mRNA in Huh7 cells | | | | | | | | |
|---|---|---|---|---|---|---|---|---|
| SED ID NO | SED ID NO (Anti- | | Average | | STAT3-5' Assay | | STAT3-3' Assay | |
| (Sense Strand) | sense Strand) | DsiRNA name | % remaining | SEM | % remaining | SEM | % remaining | SEM |
| 660 | 852 | 4831 | 49.1 | 4.0 | 44.4 | 4.9 | 53.7 | 3.2 |
| 661 | 853 | 4833 | 87.3 | 14.1 | 75.5 | 11.0 | 99.1 | 17.2 |
| 662 | 854 | 4836 | 139.9 | 17.1 | 124.8 | 15.2 | 154.9 | 19.1 |
| 663 | 855 | 4837 | 175.2 | 39.6 | 185.9 | 41.5 | 164.5 | 37.7 |
| 664 | 856 | 4909 | 27.6 | 3.2 | 30.6 | 3.8 | 24.7 | 2.6 |
| | | PC (2412) | 5.2 | 0.7 | 3.9 | 0.7 | 6.4 | 0.7 |

Figure 8A:
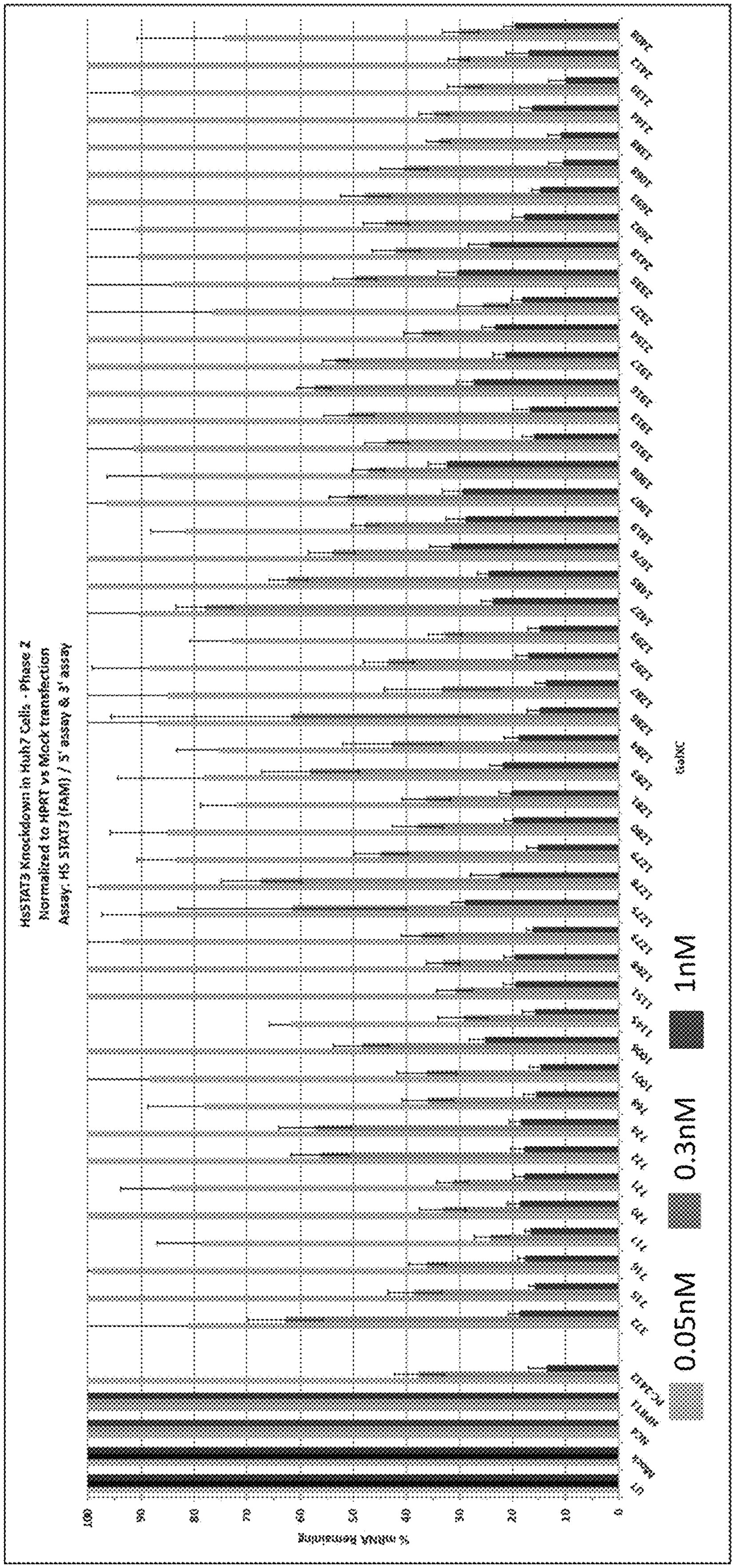
FIGS. 8A and 8B provide graphs depicting the percent (%) of human STAT3 mRNA remaining in Huh7 cells endogenously expressing human STAT3, after 24-hour treatment with 0.05 nM, 0.3 nM, or 1 nM of DsiRNA targeting various regions of the STAT3 gene. 48 GalNAc-conjugated STAT3 oligonucleotides were assayed in FIG. 8A and 34 of those oligonucleotides were selected for further testing in vivo (FIG. 8B).
Figure 8B:
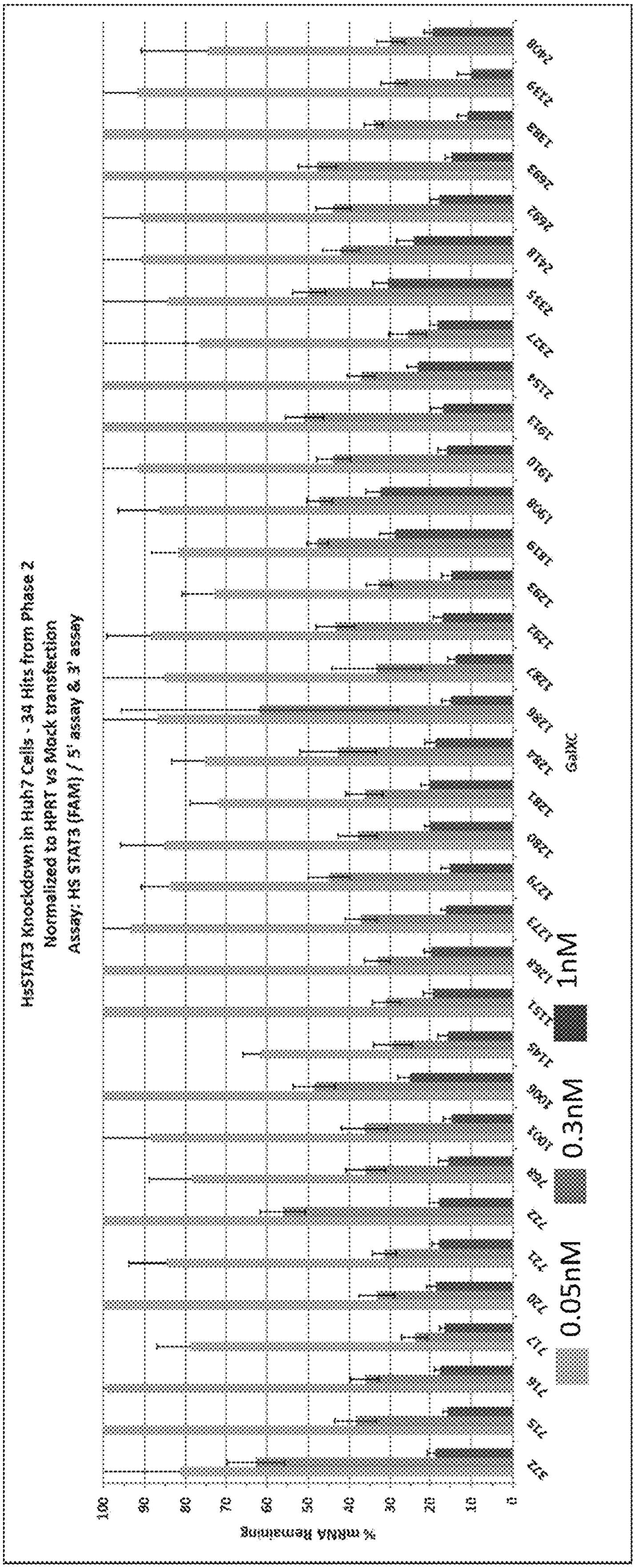

Following the initial in vitro screen, 48 constructs were selected for dosing studies. Huh7 cells were treated for 24 hours with 0.05 nM, 0.3 nM, or 1 nM of oligonucleotide. mRNA was isolated and measured to determine a potent dose (FIG. 8A). Of the tested oligonucleotides, 34 sequences were selected for further testing in vivo (Table 6 and FIG. 8B).

TABLE 6

| Analysis of STAT3 mRNA in Huh7 Dosing Study | | | | | | |
|---|---|---|---|---|---|---|
| | 1 nM | | 0.3 nM | | 0.05 nM | |
| | % Remaining mRNA | Standard Deviation | % Remaining mRNA | Standard Deviation | % Remaining mRNA | Standard Deviation |
| STAT3-372 | 18.7 | 2.0 | 62.7 | 7.0 | 81.3 | 20.0 |
| STAT3-715 | 15.7 | 1.2 | 38.4 | 5.0 | 106.5 | 11.5 |
| STAT3-716 | 17.6 | 1.3 | 36.1 | 3.4 | 99.3 | 10.2 |
| STAT3-717 | 16.6 | 1.0 | 23.9 | 3.3 | 78.8 | 8.1 |
| STAT3-720 | 18.6 | 2.3 | 33.2 | 4.3 | 111.2 | 9.0 |
| STAT3-721 | 17.8 | 1.8 | 31.4 | 2.9 | 84.6 | 9.2 |
| STAT3-722 | 17.8 | 2.4 | 56.3 | 5.4 | 109.4 | 11.7 |
| STAT3-724 | 18.5 | 2.1 | 57.2 | 6.8 | 119.7 | 11.1 |
| STAT3-768 | 15.6 | 2.3 | 36.0 | 4.8 | 78.4 | 10.4 |
| STAT3-1001 | 14.7 | 2.1 | 36.3 | 5.6 | 88.5 | 13.2 |
| STAT3-1006 | 25.2 | 3.0 | 48.5 | 5.2 | 105.4 | 14.0 |
| STAT3-1068 | 10.5 | 2.7 | 40.5 | 4.5 | 144.0 | 37.7 |
| STAT3-1145 | 15.7 | 2.4 | 29.3 | 4.6 | 61.6 | 4.3 |
| STAT3-1151 | 19.4 | 2.2 | 31.0 | 3.3 | 103.5 | 7.8 |
| STAT3-1268 | 19.7 | 1.8 | 33.1 | 3.1 | 101.6 | 10.4 |
| STAT3-1273 | 16.2 | 1.1 | 37.1 | 3.9 | 93.4 | 9.3 |
| STAT3-1275 | 29.1 | 2.5 | 61.6 | 21.5 | 89.1 | 8.3 |
| STAT3-1278 | 22.2 | 5.7 | 67.4 | 7.6 | 98.0 | 8.8 |
| STAT3-1279 | 15.3 | 2.0 | 44.9 | 5.1 | 83.6 | 7.1 |
| STAT3-1280 | 19.8 | 1.5 | 37.9 | 4.7 | 85.3 | 10.4 |
| STAT3-1281 | 20.2 | 2.2 | 36.3 | 4.5 | 71.9 | 7.0 |
| STAT3-1283 | 21.8 | 2.4 | 58.1 | 9.1 | 78.3 | 16.1 |
| STAT3-1284 | 18.8 | 2.6 | 42.7 | 9.3 | 75.2 | 8.0 |
| STAT3-1286 | 15.0 | 2.2 | 61.9 | 33.7 | 86.9 | 19.8 |
| STAT3-1287 | 13.7 | 2.0 | 33.3 | 10.9 | 85.0 | 36.0 |
| STAT3-1292 | 17.0 | 2.3 | 43.4 | 4.7 | 88.3 | 10.9 |
| STAT3-1293 | 15.0 | 2.1 | 32.8 | 3.1 | 72.9 | 7.9 |
| STAT3-1388 | 11.0 | 2.3 | 34.1 | 2.2 | 111.9 | 28.3 |
| STAT3-1427 | 23.5 | 2.3 | 78.1 | 5.4 | 90.6 | 15.0 |
| STAT3-1485 | 24.4 | 2.1 | 62.2 | 3.5 | 114.1 | 12.6 |
| STAT3-1676 | 31.5 | 4.2 | 54.1 | 4.4 | 102.3 | 9.4 |
| STAT3-1819 | 28.9 | 3.6 | 47.8 | 2.6 | 82.0 | 6.2 |
| STAT3-1907 | 29.5 | 3.8 | 51.2 | 3.4 | 96.7 | 13.5 |
| STAT3-1908 | 32.4 | 3.6 | 47.2 | 3.0 | 86.4 | 10.0 |
| STAT3-1910 | 15.9 | 2.2 | 43.8 | 4.1 | 91.6 | 19.2 |
| STAT3-1913 | 16.8 | 3.1 | 50.9 | 4.7 | 106.2 | 20.7 |
| STAT3-1916 | 27.4 | 3.2 | 57.4 | 3.2 | 153.0 | 18.1 |
| STAT3-1917 | 21.2 | 2.3 | 53.3 | 2.4 | 117.9 | 27.1 |
| STAT3-2139 | 9.9 | 3.3 | 29.1 | 3.2 | 91.8 | 15.7 |
| STAT3-2144 | 16.3 | 2.3 | 34.9 | 2.8 | 105.9 | 37.8 |
| STAT3-2154 | 23.2 | 2.6 | 37.1 | 3.4 | 113.4 | 24.6 |

TABLE 6-continued

| Analysis of STAT3 mRNA in Huh7 Dosing Study | | | | | | |
|---|---|---|---|---|---|---|
| | 1 nM | | 0.3 nM | | 0.05 nM | |
| | % Remaining mRNA | Standard Deviation | % Remaining mRNA | Standard Deviation | % Remaining mRNA | Standard Deviation |
| STAT3-2327 | 18.2 | 1.9 | 25.7 | 4.7 | 76.6 | 31.2 |
| STAT3-2335 | 30.5 | 3.6 | 49.7 | 4.0 | 84.3 | 28.4 |
| STAT3-2408 | 19.4 | 2.0 | 29.8 | 3.4 | 74.6 | 16.2 |
| STAT3-2412 | 17.0 | 4.1 | 30.3 | 1.9 | 105.7 | 29.5 |
| STAT3-2418 | 24.2 | 4.2 | 42.0 | 4.5 | 90.7 | 28.0 |
| STAT3-2692 | 17.8 | 2.3 | 43.8 | 4.2 | 91.1 | 19.3 |
| STAT3-2693 | 14.8 | 1.5 | 47.8 | 4.6 | 124.5 | 25.5 |

Example 7: RNAi Oligonucleotide Inhibition of STAT3 In Vivo

The in vitro screening assay in Example 6 validated the ability of STAT3-targeting DsiRNAs to knock-down target mRNA. To confirm the ability of the RNAi oligonucleotides to knockdown STAT3 in vivo, an HDI mouse model was used. A subset of the DsiRNAs identified in Example 6 were used to generate corresponding double-stranded RNAi oligonucleotides comprising a nicked tetraloop GalNAc-conjugated structure (referred to herein as "GalNAc-conjugated STAT3 oligonucleotides" or "GalNAc-STAT3 oligonucleotides") having a 36-mer passenger strand and a 22-mer guide strand(Table 8 and Table 9). Further, the nucleotide sequences comprising the passenger strand and guide strand have a distinct pattern of modified nucleotides and phosphorothioate linkages. Three of the nucleotides comprising the tetraloop were each conjugated to a GalNAc moiety (CAS #14131-60-3). The modification patterns used are illustrated below:

Pattern 1

Sense Strand:
5' mX-*S*-mX-mX-mX-mX-mX-mX-fX-fX-fX-fX[-mX-]16-
[ademX-GalNAc]-[ademX-GalNAc]-[ademX-GalNAc]-mX-
mX-mX-mX-mX-mX 3'.

Hybridized to:

Antisense Strand:
5' [MePhosphonate-4O-mX]-*S*-fX-*S*-fX-fX-fX-mX-
fX-mX-mX-fX-mX-mX-mX-fX-mX-mX-mX-mX-mX-mX-*S*-
mX-*S*-mX 3'.

Or, Represented as:

Sense Strand:
[mXs][mX][X][mX][mX][mX][mX][fX][fX][fX][fX][mX]]
[mX][mX][mX][mX][mX][mX][X][mX][mX][mX][mX][mX]
[mX][mX][mX][ademA-GalNAc][ademA-GalNAc][ademA-
GalNAc][mX][mX][mX][X][mX][mX]

Hybridized to:

Antisense Strand:
[MePhosphonate-4O-mXs][fXs][fX][fX][fX][mX][fX]
[mX][mX][X][mX][mX][mX][fX][mX][mX][mX][mX][mX]
[mXs][mXs][mX]

Pattern 2

Sense Strand:
5' mX-*S*-mX-mX-mX-mX-mX-mX-fX-fX-fX-fX[-mX-]16-
[ademX-GalNAc]-[ademX-GalNAc]-[ademX-GalNAc]-
mX-mX-mX-mX-mX-mX 3'.

Hybridized to:

Antisense Strand:
5' [MePhosphonate-4O-mX]-*S*-fX-*S*-fX-*S*-fX-fX-mX-
fX-mX-mX-fX-mX-mX-mX-fX-mX-mX-mX-mX-mX-mX-*S*-mX-
*S*-mX 3'.

Or, Represented as:

Sense Strand:
[mXs][mX][mX][X][mX][mX][mX][X][fX][fX][X][mX]
[mX][mX][mX][mX][mX][mX][mX][mX][X][mX][mX][mX]
[mX][mX][mX][ademA-GalNAc][ademA-GalNAc][ademA-
GalNAc][mX][mX][mX][mX][mX][mX]

Hybridized to:

Antisense Strand:
[MePhosphonate-4O-mXs][fXs][fXs][fX][fX][mX]
[fX][mX][mX][fX][mX][mX][mX][fX][mX][mX][mX]
[mX][mX][mXs][mXs][mX]

(Modification Key: Table 7).

| Symbol | Modification/linkage |
|---|---|
| | Key 1 |
| mX | 2'-O-methyl modified nucleotide |
| fX | 2'-fluoro modified nucleotide |
| -S- | phosphorothioate linkage |
| — | phosphodiester linkage |
| [MePhosphonate-4O-mX] | 4'-O-monomethylphosphonate-2'-O-methyl modified nucleotide |
| ademA-GalNAc | 2'-aminodiethoxymethanol-adenine-GalNAc (GalNAc attached to an adenine nucleotide) |
| | Key 2 |
| [mXs] | 2'-O-methyl modified nucleotide with a phosphorothioate linkage to the neighboring nucleotide |
| [fXs] | 2'-fluoro modified nucleotide with a phosphorothioate linkage to the neighboring nucleotide |
| [mX] | 2'-O-methyl modified nucleotide with phosphodiester linkages to neighboring nucleotides |
| [fX] | 2'-fluoro modified nucleotide with phosphodiester linkages to neighboring nucleotides |

Oligonucleotides in Table 8 and Table 9 were evaluated in mice engineered to transiently express human STAT3 mRNA in hepatocytes of the mouse liver. Briefly, 6-8-week-old female CD-1 mice (n=4-5) were subcutaneously administered the indicated GalNAc-conjugated STAT3 oligonucleotides at a dose of 1 mg/kg formulated in PBS. A control group of mice (n=3-4) were administered only PBS. Three days later (72 hours), the mice were hydrodynamically injected (HDI) with a DNA plasmid encoding the full human STAT3 gene (25 ug) under control of a ubiquitous cytomegalovirus (CMV) promoter sequence. One day after introduction of the DNA plasmid, liver samples from HDI mice were collected. Total RNA derived from these HDI mice were subjected to qRT-PCR analysis to determine STAT3 mRNA levels as described in Example 6. mRNA levels were measured for human mRNA. The values were normalized for transfection efficiency using the NeoR gene included on the DNA plasmid. A benchmark control (STAT3-1388) comprising a different modification pattern, was used for both assays (Sense Strand SEQ ID NO: 1100; Antisense Strand SEQ ID NO: 1190).

TABLE 8

GalNAc-Conjugated STAT3 RNAi Oligonucleotides for HDI screen

| | Unmodified Sense Strand | Unmodified Antisense strand | Modified Sense Strand | Modified Antisense strand |
|---|---|---|---|---|
| STAT3-372 | 861 | 951 | 1041 | 1131 |
| STAT3-715 | 857 | 947 | 1037 | 1127 |
| STAT3-716 | 858 | 948 | 1038 | 1128 |
| STAT3-717 | 859 | 949 | 1039 | 1129 |
| STAT3-720 | 860 | 950 | 1040 | 1130 |
| STAT3-721 | 862 | 952 | 1042 | 1132 |
| STAT3-722 | 863 | 953 | 1043 | 1133 |
| STAT3-768 | 864 | 954 | 1044 | 1134 |
| STAT3-1001 | 865 | 955 | 1045 | 1135 |
| STAT3-1006 | 866 | 956 | 1046 | 1136 |
| STAT3-1145 | 867 | 957 | 1047 | 1137 |
| STAT3-1151 | 868 | 958 | 1048 | 1138 |
| STAT3-1268 | 869 | 959 | 1049 | 1139 |
| STAT3-1273 | 870 | 960 | 1050 | 1140 |
| STAT3-1279 | 871 | 961 | 1051 | 1141 |

TABLE 8-continued

GalNAc-Conjugated STAT3 RNAi Oligonucleotides for HDI screen

| | Unmodified Sense Strand | Unmodified Antisense strand | Modified Sense Strand | Modified Antisense strand |
|---|---|---|---|---|
| STAT3-1280 | 872 | 962 | 1052 | 1142 |
| STAT3-1281 | 873 | 963 | 1053 | 1143 |
| STAT3-1388 | 920 | 1010 | 1100 | 1190 |

TABLE 9

GalNAc-Conjugated STAT3 RNAi Oligonucleotides for HDI screen

| | Unmodified Sense Strand | Unmodified Antisense strand | Modified Sense Strand | Modified Antisense strand |
|---|---|---|---|---|
| STAT3-1284 | 874 | 964 | 1054 | 1144 |
| STAT3-1286 | 875 | 965 | 1055 | 1145 |
| STAT3-1287 | 876 | 966 | 1056 | 1146 |
| STAT3-1292 | 877 | 967 | 1057 | 1147 |
| STAT3-1293 | 878 | 968 | 1058 | 1148 |
| STAT3-1819 | 879 | 969 | 1059 | 1149 |
| STAT3-1908 | 880 | 970 | 1060 | 1150 |
| STAT3-1910 | 881 | 971 | 1061 | 1151 |
| STAT3-1913 | 882 | 972 | 1062 | 1152 |
| STAT3-2154 | 883 | 973 | 1063 | 1153 |
| STAT3-2327 | 884 | 974 | 1064 | 1154 |
| STAT3-2335 | 885 | 975 | 1065 | 1155 |
| STAT3-2418 | 886 | 976 | 1066 | 1156 |
| STAT3-2692 | 887 | 977 | 1067 | 1157 |
| STAT3-2693 | 888 | 978 | 1068 | 1158 |
| STAT3-2139 | 940 | 1030 | 1120 | 1210 |
| STAT3-2408 | 896 | 986 | 1076 | 1166 |
| STAT3-1388 | 920 | 1010 | 1100 | 1190 |

Figure 9A:
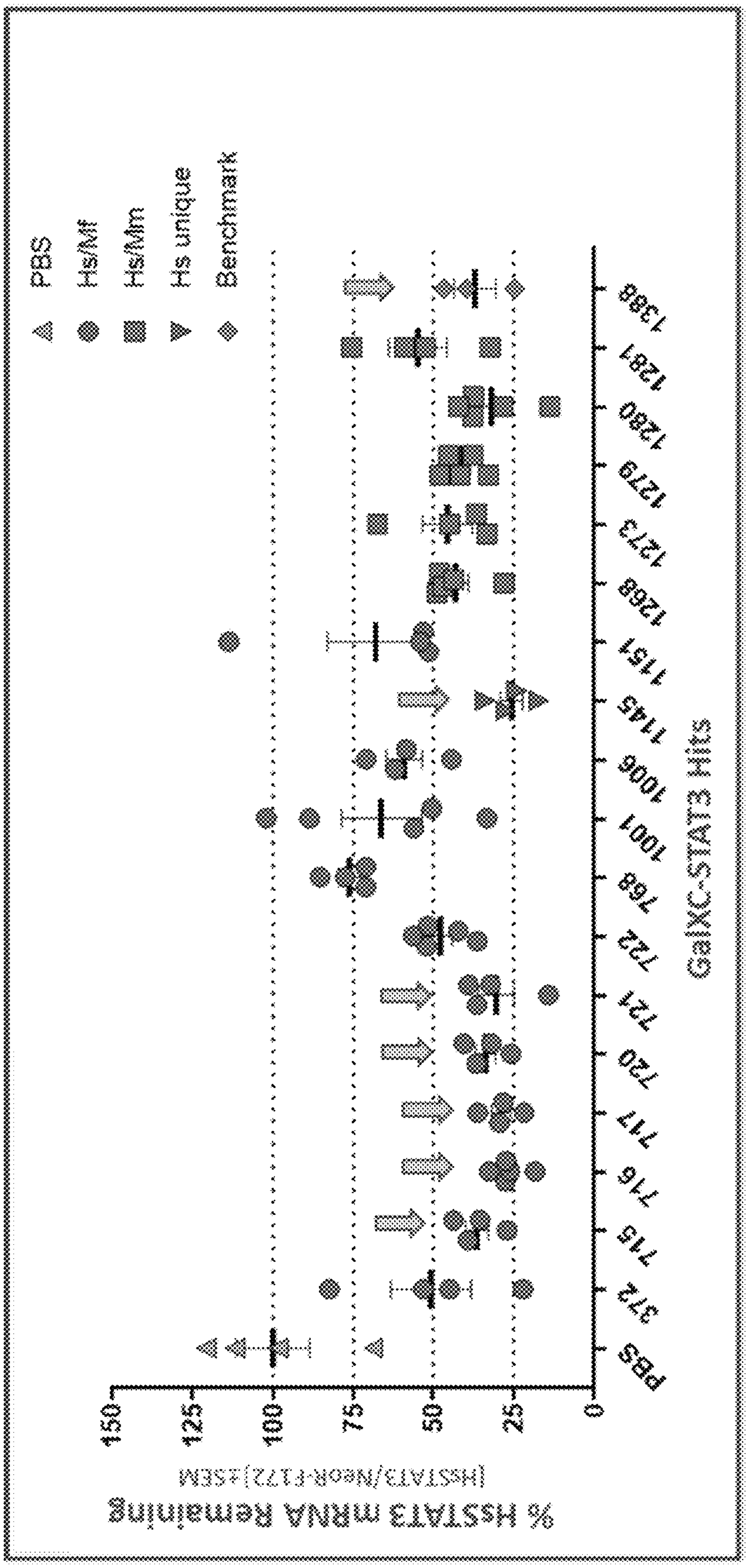
FIGS. 9A and 9B provide graphs depicting the percent (%) of human STAT3 mRNA remaining in liver of mice exogenously expressing human STAT3 (hydrodynamic injection model) after treatment with GalNAc-conjugated STAT3 oligonucleotides. Mice were dosed subcutaneously with 1 mg/kg of the indicated GalNAc-STAT3 oligonucleotides formulated in PBS. Three days post-dose mice were hydrodynamically injected (HDI) with a DNA plasmid encoding human STAT3. The level of human STAT3 mRNA was determined from livers collected 18 hours after injection. Arrows indicate oligonucleotides selected for dose response analysis. Hs/Mf=human/monkey common sequence; Hs/Mm=human/mouse common sequence; Hs/Mf/Mm=human/monkey/mouse triple common sequence.
Figure 9B:
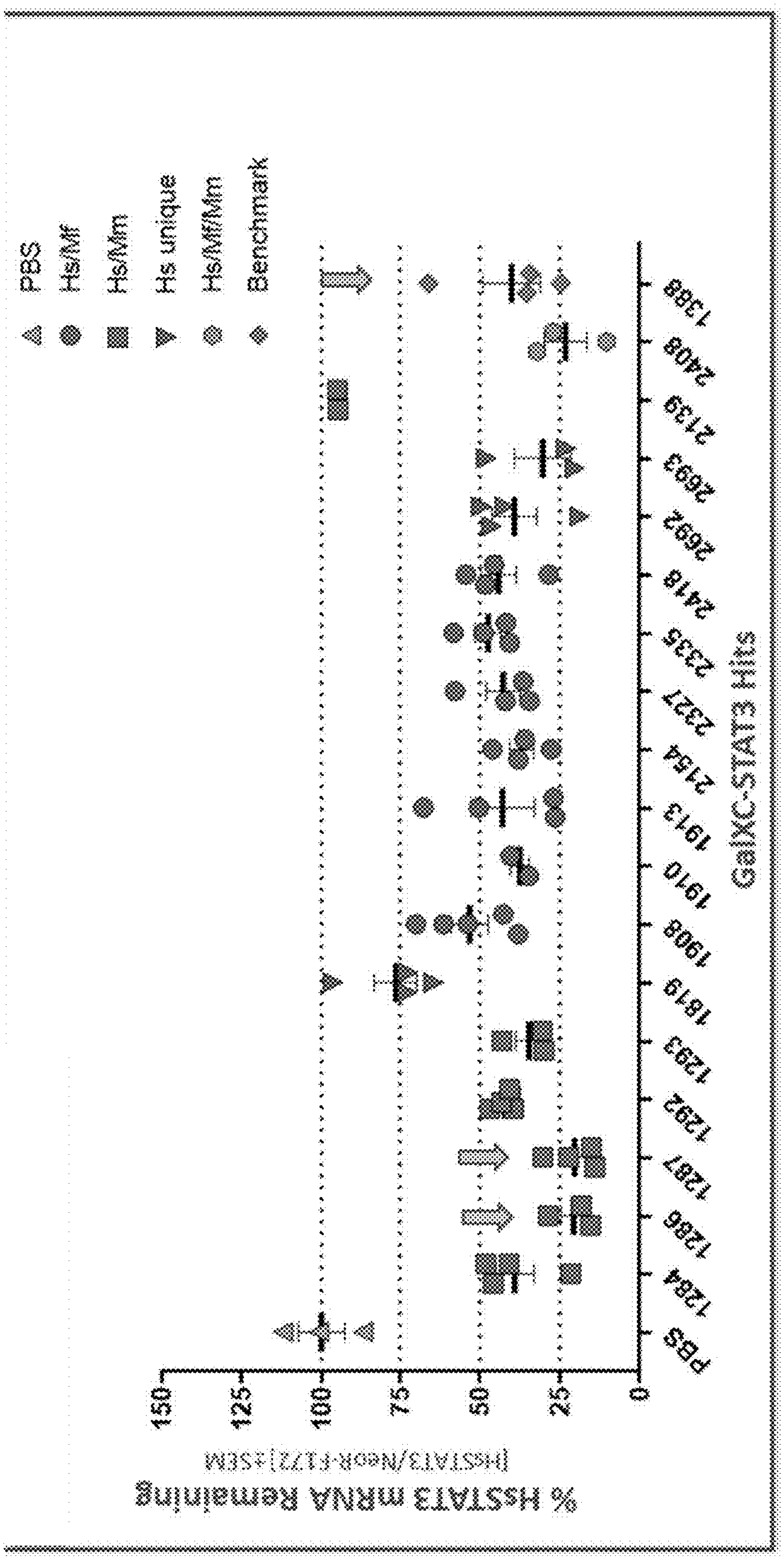

The results in FIGS. 9A and 9B demonstrate that GalNAc-conjugated STAT3 oligonucleotides designed to target human STAT3 mRNA inhibited human STAT3 mRNA expression in HDI mice, as determined by a reduction in the amount of human STAT3 mRNA expression in liver samples from HDI mice treated with GalNAc-conjugated STAT3 oligonucleotides relative to control HDI mice treated with only PBS.

Figure 10:
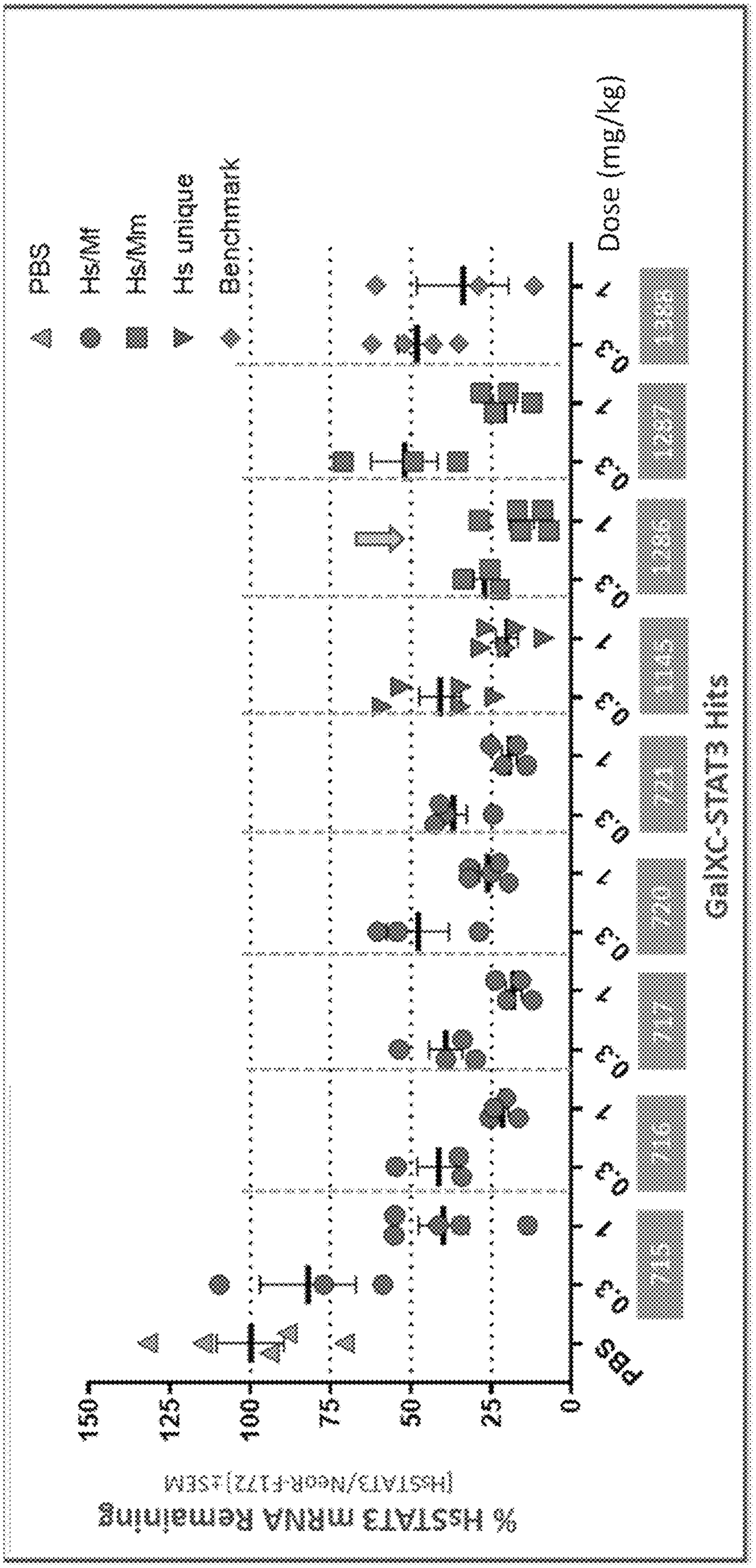
FIG. 10 provides a graph depicting the dose response of GalNAc-conjugated STAT3 oligonucleotides. The percent (%) of human STAT3 mRNA remaining in liver of mice exogenously expressing STAT3 (HDI model) after treatment with human GalNAc-conjugated STAT3 oligonucleotides at two different doses (0.3 mg/kg or 1 mg/kg,) was measured. The level of human STAT3 mRNA was determined from livers collected 18 hours after injection with plasmid encoding human STAT3. Arrows indicate oligonucleotides selected for dose response analysis. Hs/Mf=human/monkey common sequence; Hs/Mm=human/mouse common sequence.

A subset of the GalNAc-conjugated STAT3 oligonucleotides tested in FIGS. 9A and 9B were further validated in a dosing study. Specifically, dosing studies were carried out using nine GalNAc-conjugated STAT3 oligonucleotides (STAT3-715, STAT3-716, STAT3-717, STAT3-720, STAT3-721, STAT3-1145, STAT3-1286, STAT3-1287, and STAT3-1287). Mice were hydrodynamically injected as described above and treated with 0.1 mg/kg, 0.3 mg/kg, or 1 mg/kg of oligonucleotide. Livers were collected after one day, and STAT3 expression was measured to determine a potent dose (FIG. 10). All GalNAc-conjugated STAT3 oligonucleotides were able to reduce STAT3 expression at a 1 mg/kg dose and STAT3-1286 was able to reduce expression at a 0.3 mg/kg dose. Overall, the HDI studies identified several potential GalNAc-conjugated STAT3 oligonucleotides for inhibiting STAT3 expression in liver.

Example 8: Species Specific RNAi Oligonucleotide Inhibition of STAT3 In Vivo

To confirm the ability of RNAi oligonucleotides to knockdown STAT3 in vivo, several cross species and species specific GalNAc-conjugated STAT3 oligonucleotides were generated. Specifically, triple common (targeting human, non-human primate, and mouse; Hs/Mf/Mm), human/mouse (Hs/Mm), and human specific (Hs) oligonucleotides were evaluated.

Hs/Mf/Mm and Hs/Mm Commons

Figure 11:
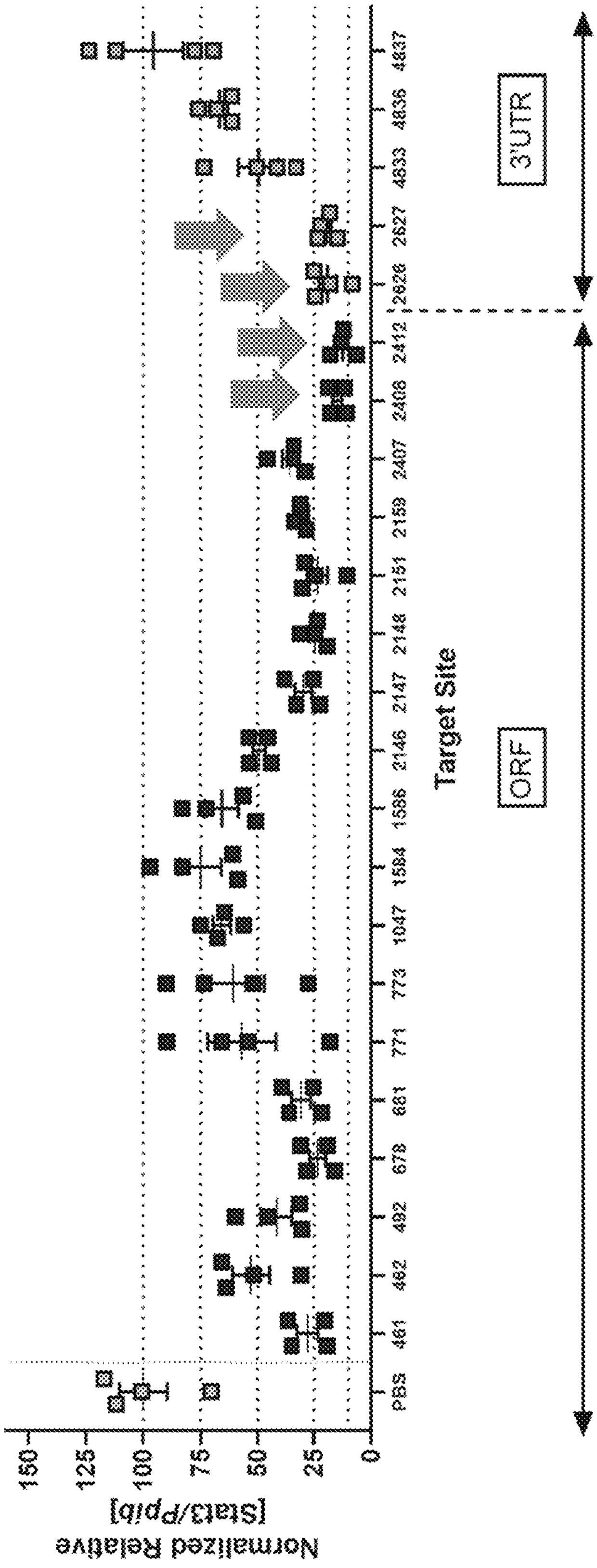
FIG. 11 provides a graph depicting the normalized (to Ppib) relative mouse STAT3 mRNA remaining in liver of mice endogenously expressing mouse STAT3 after treatment with GalNAc-conjugated STAT3 oligonucleotides. Mice were dosed subcutaneously with 3 mg/kg of the indicated GalNAc-STAT3 oligonucleotides formulated in PBS. Five days post-dose liver was collected and the level of mouse STAT3 mRNA was determined. Arrows indicate top oligonucleotides and those selected for dose response study.

Mice expressing endogenous mouse STAT3 in the liver were subcutaneously injected at a dose of 3 mg/kg with the GalNAc-conjugated STAT3 oligonucleotides set forth in Table 10. Livers were collected after five days, and STAT3 expression was measured. Overall, the study identified several potential Hs/Mf/Mm GalNAc-conjugated STAT3 oligonucleotides for inhibiting STAT3 expression in liver (FIG. 11).

TABLE 10

GalNAc-Conjugated Human/Monkey/Mouse STAT3 RNAi Oligonucleotides for Endogenous STAT3 screen.

| | Unmodified Sense Strand | Unmodified Antisense strand | Modified Sense Strand | Modified Antisense strand |
|---|---|---|---|---|
| STAT3-461 | 901 | 991 | 1081 | 1171 |
| STAT3-462 | 906 | 996 | 1086 | 1176 |
| STAT3-492 | 905 | 995 | 1085 | 1175 |
| STAT3-678 | 910 | 1000 | 1090 | 1180 |
| STAT3-681 | 909 | 999 | 1089 | 1179 |
| STAT3-771 | 908 | 998 | 1088 | 1178 |
| STAT3-773 | 904 | 994 | 1084 | 1174 |
| STAT3-1047 | 903 | 993 | 1083 | 1173 |
| STAT3-1584 | 902 | 992 | 1082 | 1172 |
| STAT3-1586 | 907 | 997 | 1087 | 1177 |
| STAT3-2146 | 898 | 988 | 1078 | 1168 |
| STAT3-2147 | 900 | 990 | 1080 | 1170 |
| STAT3-2148 | 899 | 989 | 1079 | 1169 |
| STAT3-2151 | 893 | 983 | 1073 | 1163 |
| STAT3-2159 | 897 | 987 | 1077 | 1167 |
| STAT3-2407 | 891 | 981 | 1071 | 1161 |
| STAT3-2408 | 896 | 986 | 1076 | 1166 |
| STAT3-2412 | 892 | 982 | 1072 | 1162 |
| STAT3-2626 | 890 | 980 | 1070 | 1160 |
| STAT3-2627 | 889 | 979 | 1069 | 1159 |
| STAT3-4833 | 912 | 1002 | 1092 | 1182 |
| STAT3-4836 | 895 | 985 | 1075 | 1165 |
| STAT3-4837 | 911 | 1001 | 1091 | 1181 |

Figure 12:
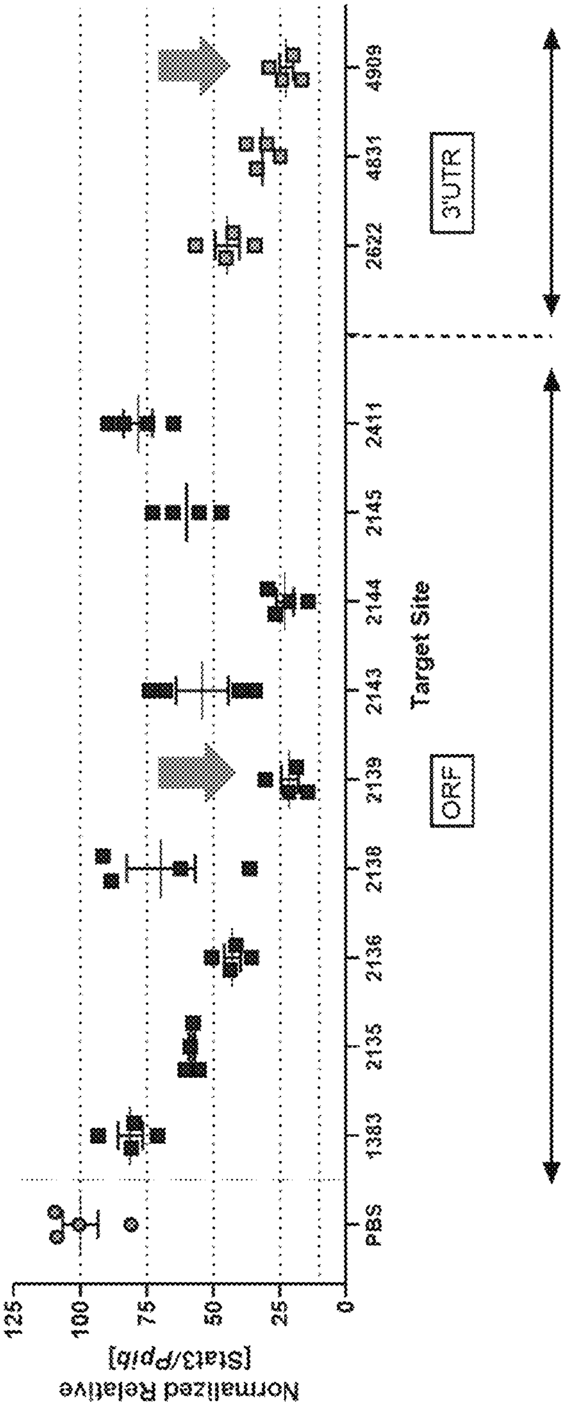
FIG. 12 provides a graph depicting the normalized (to Ppib) relative mouse STAT3 mRNA remaining in liver of mice endogenously expressing mouse STAT3 after treatment with GalNAc-conjugated STAT3 oligonucleotides. Mice were dosed subcutaneously with 3 mg/kg of the indicated GalNAc-STAT3 oligonucleotides formulated in PBS. Five days post-dose liver was collected and the level of mouse STAT3 mRNA was determined. Arrows indicate oligonucleotides selected for dose response study.

Human/Mouse GalNAc-conjugated STAT3 oligonucleotides set forth in Table 11 were tested in mice endogenously expressing mouse STAT3. As described above, mice were subcutaneously injected at a dose of 3 mg/kg with oligonucleotide. Livers were collected after five days, and mouse STAT3 expression was measured. Overall, the study identified several potential Hs/Mm GalNAc-conjugated STAT3 oligonucleotides for inhibiting STAT3 expression in liver (FIG. 12).

TABLE 11

GalNAc-Conjugated Human/Mouse STAT3 RNAi Oligonucleotides for Endogenous STAT3 Screen.

| | Unmodified Sense Strand | Unmodified Antisense strand | Modified Sense Strand | Modified Antisense strand |
|---|---|---|---|---|
| STAT3-1383 | 946 | 1036 | 1126 | 1216 |
| STAT3-2135 | 945 | 1035 | 1125 | 1206 |
| STAT3-2136 | 935 | 1025 | 1115 | 1205 |
| STAT3-2138 | 938 | 1028 | 1118 | 1208 |
| STAT3-2139 | 940 | 1030 | 1120 | 1210 |
| STAT3-2143 | 936 | 1026 | 1116 | 1206 |
| STAT3-2144 | 937 | 1027 | 1117 | 1207 |
| STAT3-2145 | 942 | 1032 | 1122 | 1212 |
| STAT3-2411 | 941 | 1031 | 1121 | 1211 |
| STAT3-2622 | 944 | 1034 | 1124 | 1214 |
| STAT3-4831 | 943 | 1033 | 1123 | 1213 |
| STAT3-4909 | 939 | 1029 | 1119 | 1209 |

Figure 13A:
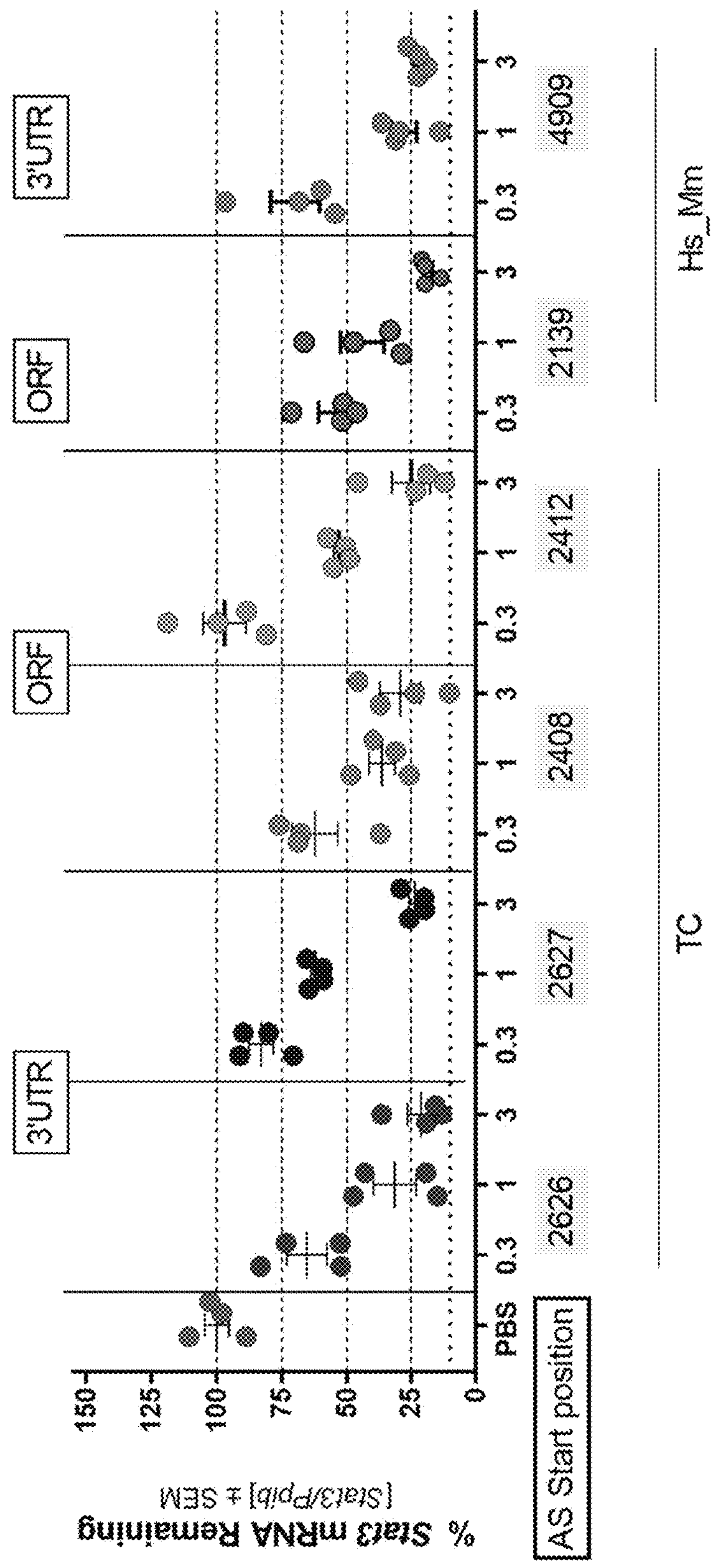
FIGS. 13A and 13B provide graphs depicting the dose response of GalNAc-conjugated STAT3 oligonucleotides. The percent (%) of mouse STAT3 mRNA remaining in liver of mice endogenously expressing STAT3 after treatment with human GalNAc-conjugated STAT3 oligonucleotides at three doses (0.3 mg/kg, 1 mg/kg, and 3 mg/kg) was measured. The level of mouse STAT3 mRNA was determined from livers collected 5 days later. TC=triple common (mouse/human/monkey); Hs_Mm=human/mouse.
Figure 13B:
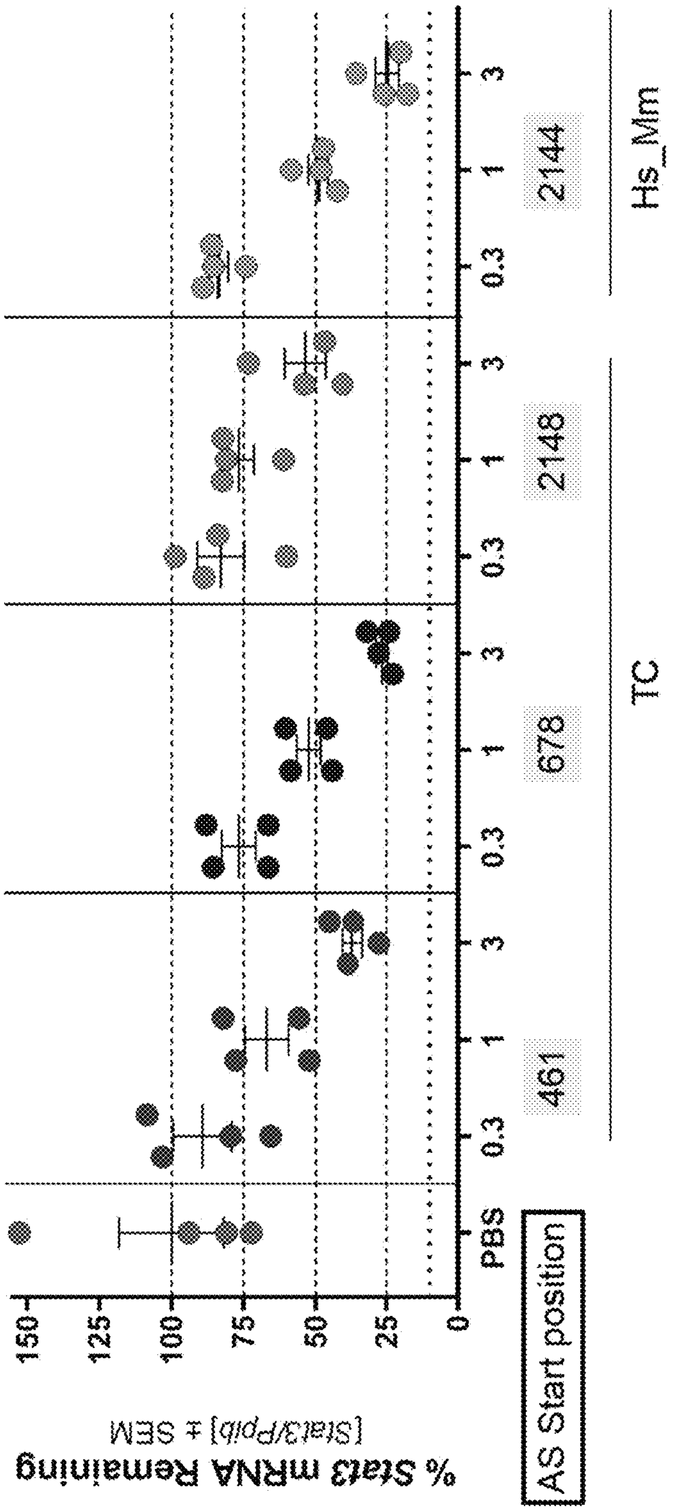

A subset of the GalNAc-conjugated STAT3 oligonucleotides tested in FIGS. 11 and 12 were further validated in a dosing study. Specifically, dosing studies were carried out using ten GalNAc-conjugated STAT3 oligonucleotides (STAT3-2626, STAT3-2627, STAT3-2408, STAT3-2412, STAT3-2139, STAT3-4909, STAT3-461, STAT3-678, STAT3-2148, and STAT3-2144). Mice endogenously expressing mouse STAT3 were subcutaneously injected with 0.3 mg/kg, 1 mg/kg, or 3 mg/kg oligonucleotide. Livers were collected after five days, and mouse STAT3 expression was measured to determine a potent dose (FIGS. 13A and 13B). Overall, the endogenous mouse STAT3 expression studies identified several potential GalNAc-conjugated STAT3 oligonucleotides for inhibiting mouse STAT3 expression in liver.

Hs Specific

Using the HDI model described in Example 7, human specific GalNAc-conjugated STAT3 oligonucleotides were evaluated. Specifically, 6-8-week-old female CD-1 mice (n=4-5) were subcutaneously administered the indicated GalNAc-conjugated STAT3 oligonucleotides (Table 12) at a dose of 1 mg/kg formulated in PBS. A control group of mice (n=3-4) were administered only PBS. Three days later (72 hours), the mice were hydrodynamically injected (HDI) with a DNA plasmid encoding the full human STAT3 gene (25 μg) under control of a ubiquitous cytomegalovirus (CMV) promoter sequence. One day after introduction of the DNA plasmid, liver samples from HDI mice were collected. Total RNA derived from these HDI mice were subjected to qRT-PCR analysis to determine STAT3 mRNA levels.

TABLE 12

GalNAc-Conjugated Human STAT3 RNAi Oligonucleotides for Exogenous STAT3 Screen.

| | Unmodified Sense Strand | Unmodified Antisense strand | Modified Sense Strand | Modified Antisense strand |
|---|---|---|---|---|
| STAT3-424 | 926 | 1016 | 1106 | 1196 |
| STAT3-425 | 932 | 1022 | 1112 | 1202 |
| STAT3-426 | 915 | 1005 | 1095 | 1185 |
| STAT3-429 | 921 | 1011 | 1101 | 1191 |
| STAT3-430 | 923 | 1013 | 1103 | 1193 |
| STAT3-432 | 924 | 1014 | 1104 | 1194 |
| STAT3-433 | 918 | 1008 | 1098 | 1188 |
| STAT3-1067 | 917 | 1007 | 1097 | 1187 |
| STAT3-1670 | 919 | 1009 | 1099 | 1189 |
| STAT3-1241 | 930 | 1020 | 1110 | 1200 |
| STAT3-1388 | 920 | 1010 | 1100 | 1190 |
| STAT3-1671 | 934 | 1024 | 1114 | 1204 |
| STAT3-1672 | 931 | 1021 | 1111 | 1201 |
| STAT3-1673 | 914 | 1004 | 1094 | 1184 |
| STAT3-1674 | 929 | 1019 | 1109 | 1199 |
| STAT3-1813 | 928 | 1018 | 1108 | 1198 |
| STAT3-1815 | 925 | 1015 | 1105 | 1195 |
| STAT3-1817 | 933 | 1023 | 1113 | 1203 |

TABLE 12-continued

| GalNAc-Conjugated Human STAT3 RNAi Oligonucleotides for Exogenous STAT3 Screen. | | | | |
|---|---|---|---|---|
| | Unmodified Sense Strand | Unmodified Antisense strand | Modified Sense Strand | Modified Antisense strand |
| STAT3-2024 | 927 | 1017 | 1107 | 1197 |
| STAT3-2404 | 916 | 1006 | 1096 | 1186 |
| STAT3-2405 | 922 | 1012 | 1102 | 1192 |

Figure 14:
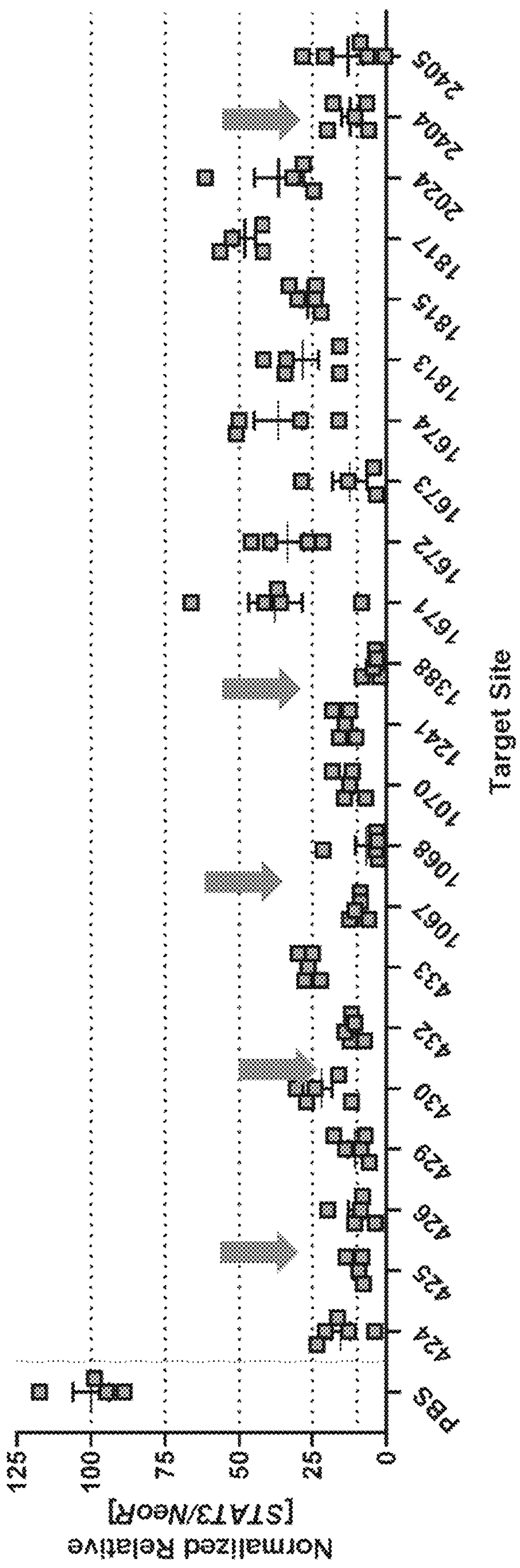
FIG. 14 provides a graph depicting the percent (%) of human STAT3 mRNA remaining in liver of mice exogenously expressing human STAT3 (hydrodynamic injection model) after treatment with GalNAc-conjugated STAT3 oligonucleotides. Mice were dosed subcutaneously with 1 mg/kg of the indicated GalNAc-STAT3 oligonucleotides formulated in PBS. Three days post-dose mice were hydrodynamically injected (HDI) with a DNA plasmid encoding human STAT3. The level of human STAT3 mRNA was determined from livers collected 18 hours after injection. Arrows indicate oligonucleotides selected for dose response study.

The results in FIG. 14 demonstrate that GalNAc-conjugated STAT3 oligonucleotides designed to target human STAT3 mRNA inhibited human STAT3 mRNA expression in HDI mice, as determined by a reduction in the amount of human STAT3 mRNA expression in liver samples from HDI mice treated with GalNAc-conjugated STAT3 oligonucleotides relative to control HDI mice treated with only PBS.

Figure 15:
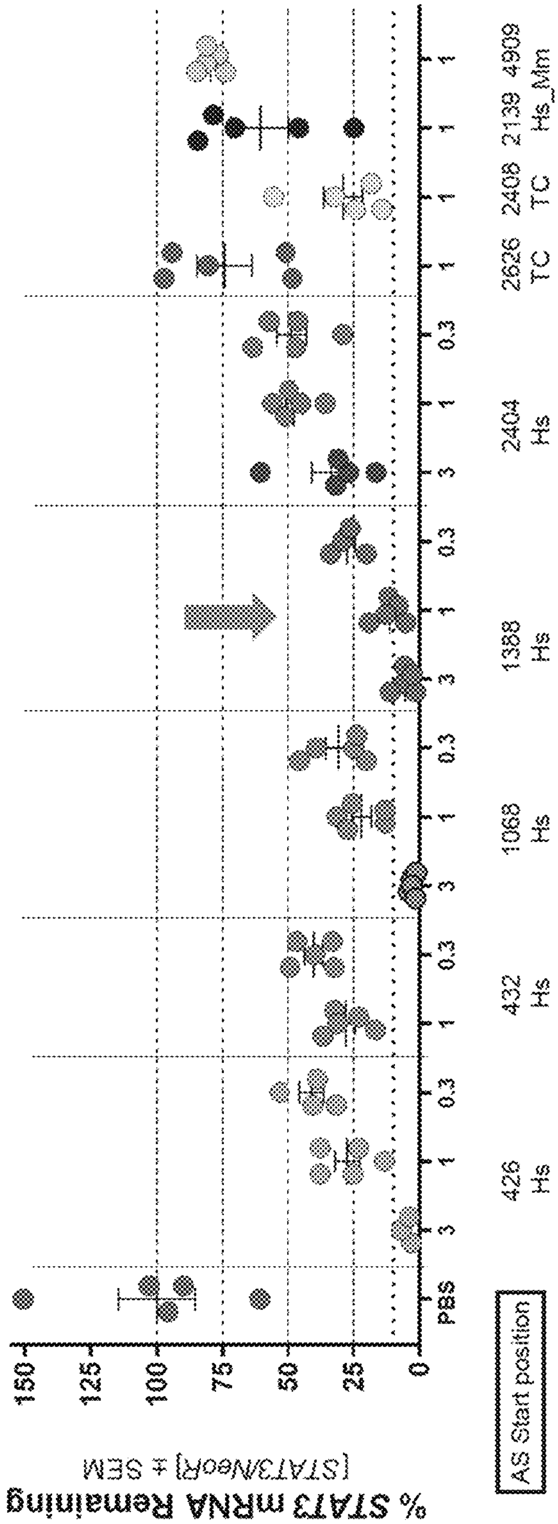
FIG. 15 provides a graph depicting the dose response of GalNAc-conjugated STAT3 oligonucleotides. The percent (%) of human STAT3 mRNA remaining in liver of mice exogenously expressing human STAT3 (hydrodynamic injection model) after treatment with GalNAc-conjugated STAT3 oligonucleotides. Mice were dosed subcutaneously with three doses (0.3 mg/kg, 1 mg/kg, and 3 mg/kg) of the indicated GalNAc-STAT3 oligonucleotides formulated in PBS. Three days post-dose mice were hydrodynamically injected (HDI) with a DNA plasmid encoding human STAT3. The level of human STAT3 mRNA was determined from livers collected 18 hours after injection. TC=triple common (mouse/human/monkey); Hs_Mm=human/mouse; Hs=human.
Figure 16:
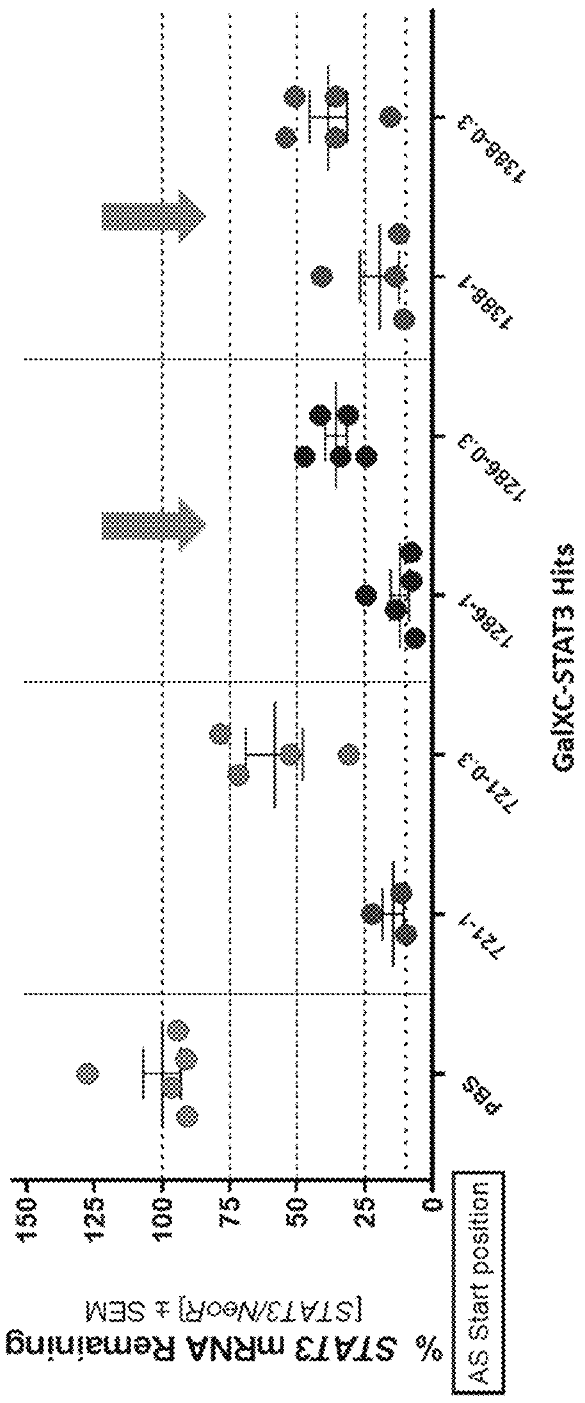
FIG. 16 provides a graph depicting the dose response of GalNAc-conjugated STAT3 oligonucleotides. The percent (%) of human STAT3 mRNA remaining in liver of mice exogenously expressing human STAT3 (hydrodynamic injection model) after treatment with GalNAc-conjugated STAT3 oligonucleotides. Mice were dosed subcutaneously with two doses (0.3 mg/kg and 1 mg/kg) of the indicated GalNAc-STAT3 oligonucleotides formulated in PBS. Three days post-dose mice were hydrodynamically injected (HDI) with a DNA plasmid encoding human STAT3. The level of human STAT3 mRNA was determined from livers collected 18 hours after injection.

A subset of the GalNAc-conjugated STAT3 oligonucleotides tested in FIG. 14 were further validated in a dosing study. Specifically, dosing studies were carried out using five GalNAc-conjugated STAT3 oligonucleotides (STAT3-426, STAT3-432, STAT3-1068, STAT3-1388, and STAT3-2404). Mice were hydrodynamically injected as described above and treated with 0.3 mg/kg, 1 mg/kg, or 3 mg/kg of oligonucleotide. Livers were collected after one day, and human STAT3 expression was measured to determine a potent dose (FIG. 15). A dose of 1 mg/kg was capable of reducing STAT3 mRNA by about 75%, thereby identifying several potential GalNAc-conjugated STAT3 oligonucleotides for inhibiting STAT3 expression in liver. The best 2 sequences from FIG. 23 and the best sequence from FIG. 28 are tested in the final HDI screen (FIG. 16).

Figure 17:
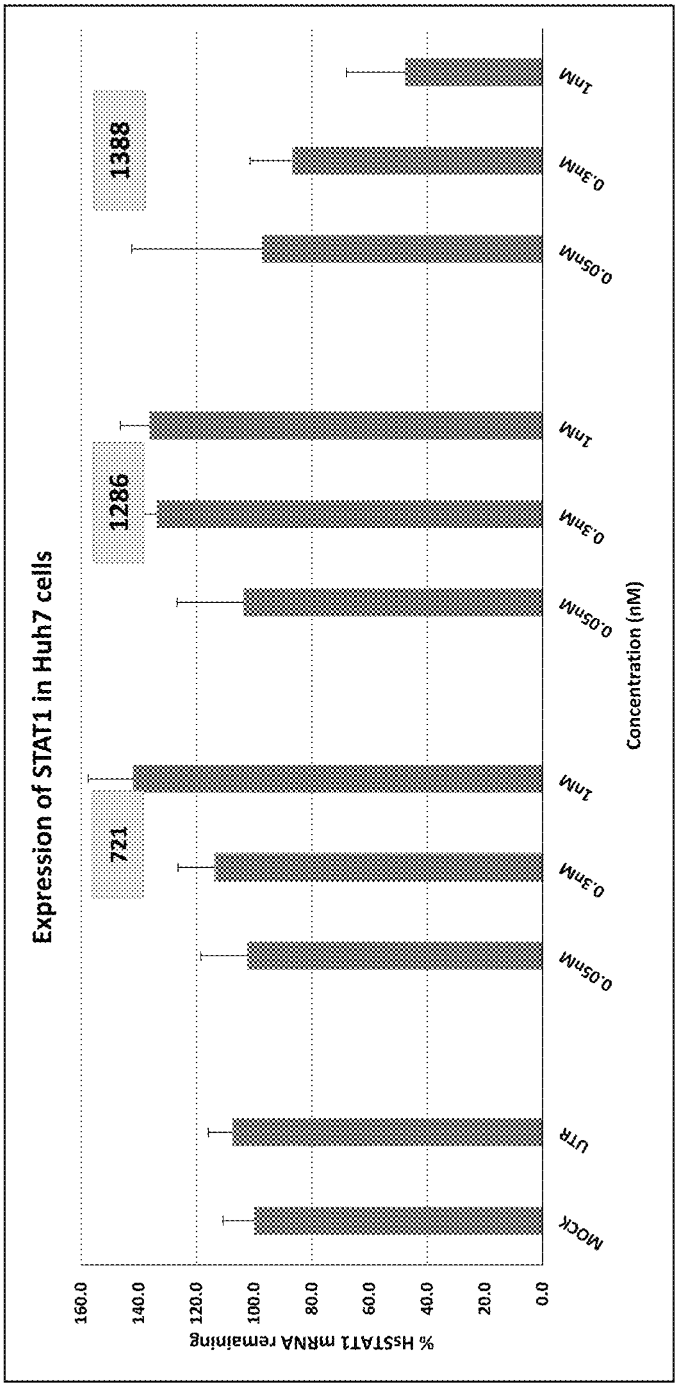
FIG. 17 provides a graph depicting the percent (%) remaining human STAT1 mRNA in Huh7 cells endogenously expressing STAT3 and STAT1 treated with GalNAc-conjugated STAT3 oligonucleotides. Cells were treated for 24 hours with three doses (0.05 nM, 0.3 nM, and 1 nM) of oligonucleotide.

Example 9: Specific STAT3 Inhibition by GalNAc-Conjugated STAT3 Oligonucleotides The specificity of the GalNAc-conjugated STAT3 oligonucleotides to inhibit STAT3 rather than a family member (e.g., STAT1) was measured. Specifically, Huh7 cells expressing endogenous STAT1 were treated for 24 hours with 0.05 nM, 0.3 nM, or 1 nM of a GalNAc-conjugated STAT3 oligonucleotide (STAT3-721, STAT3-1286, and STAT3-1388) using lipofectamine as transfection agent. The percent (%) remaining mRNA was measured compared to a mock control (PBS; no lipofectamine or siRNA) and UTR (un-transfected; treated with lipofectamine but no siRNA) (Table 13 and FIG. 17). STAT3 721 and 1286 did not downregulate human STAT1 but STAT3 1388 did(Table 13). Oligonucleotides did not downregulate STAT1 expression demonstrating a specificity for STAT3 with limited off-target effects for STAT1.

TABLE 13

| STAT1 Expression | | | |
|---|---|---|---|
| Sample | Concentration | % Expression | SEM |
| Mock | | 100.0 | 10.8 |
| UTR | | 107.5 | 8.4 |
| STAT3-721 | 0.05 nM | 102.3 | 16.2 |
| | 0.3 nM | 113.6 | 12.8 |
| | 1 nM | 142.0 | 15.6 |
| STAT3-1286 | 0.05 nM | 103.7 | 23.0 |
| | 0.3 nM | 133.8 | 9.6 |
| | 1 nM | 136.3 | 10.0 |

TABLE 13-continued

| STAT1 Expression | | | |
|---|---|---|---|
| Sample | Concentration | % Expression | SEM |
| STAT3-1388 | 0.05 nM | 97.3 | 45.2 |
| | 0.3 nM | 86.8 | 14.6 |
| | 1 nM | 47.7 | 20.3 |

Example 10: STAT3 Inhibition in Combination with Checkpoint Inhibition Significantly Improves Anti-Tumor Efficacy To evaluate the performance of GalXC-STAT3-C18 conjugates as single agent or in combination with a checkpoint inhibitor, anti-PD-L1 mAb, Pan02 tumors ($2\times10^6$ cells) were implanted in 6-8 week old C57BL/6 mice and upon reaching 300-400 $mm^3$ volume mice were subjected to randomization. Mice received either a single dose of GalXC-STAT3-C18-4123 subcutaneously at 25 mg/kg as single agent or in combination with an anti-PD-L1 mAb (anti-mouse PD-L1 mAb (B7-H1), Clone 10F.9G2) at 10 mg/kg (i.p.). Mice were first administered two doses three days apart, and two weeks later were administered two more doses three days apart [(q3d×2)×2]. Control groups were treated with either GalXC-Placebo as single agent or in combination with the anti-PD-L1 mAb as described for the GalXC-STAT3-C18-4123 compound. Two weeks after the last dose, the same dose regimen was repeated. Tumor sizes were measured twice a week throughout the study period.

Figure 18A:
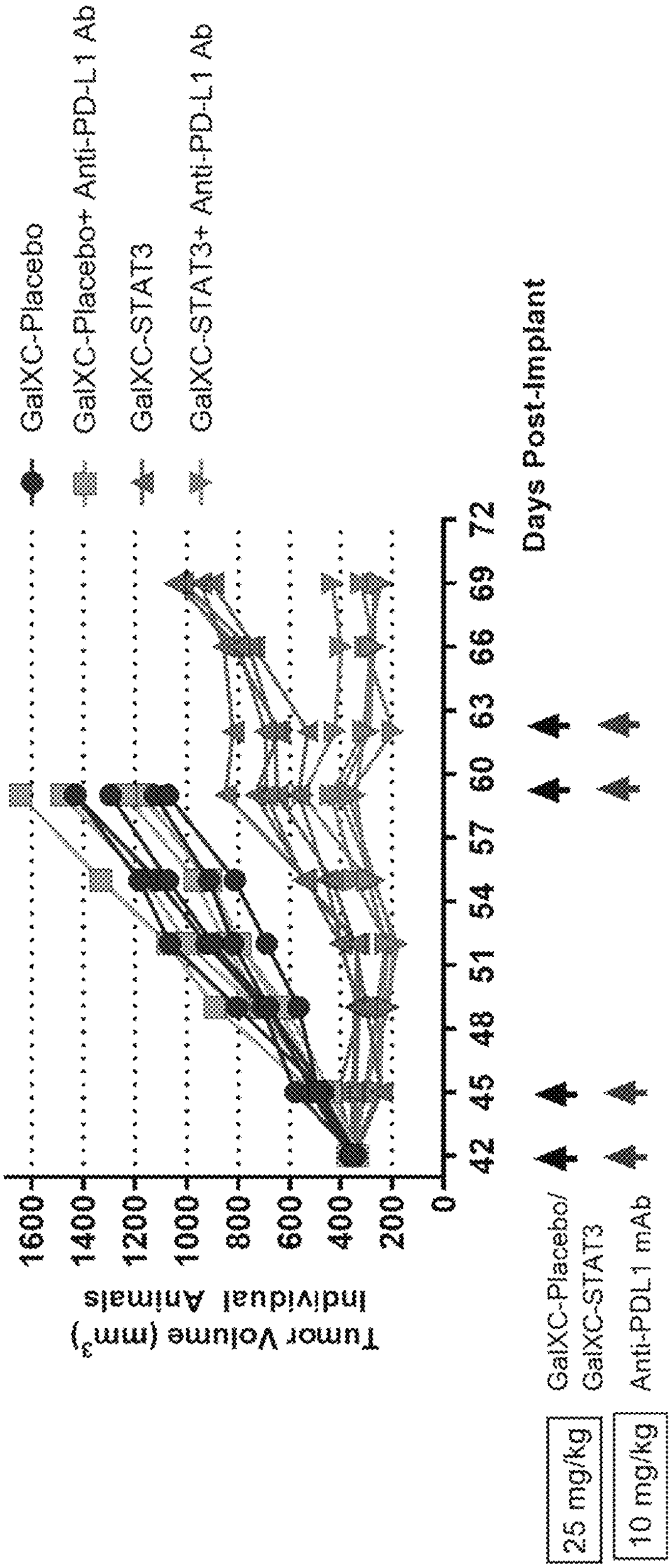
FIG. 18A provides a graph depicting tumor volume after administration of a GalXC-STAT3-C18 oligonucleotide alone or in combination with an anti-PD-L1 mAb. Immunocompetent mice bearing Pan02 murine pancreatic tumors were dosed subcutaneously (s.c.) with 25 mg/kg of GalXC-STAT3-C18-4123 with intraperitoneal (i.p.) treatment of 10 mg/kg of anti-PD-L1 mAb. Controls included GalXC-Placebo (an HBV siRNA with identical chemistry and lipid conjugation as GalXC-STAT3 oligonucleotides), GalXC-STAT3-C18-4123 at 25 mg/kg or GalXC-Placebo at 25 mg/kg in combination with anti-PD-L1 mAb at 10 mg/kg. Mice were first administered two doses three days apart, and two weeks later were administered two more doses three days apart [(q3d×2)×2]. Arrows indicate days doses were administered.

As shown in FIG. 18A, the tumors that received GalXC-Placebo or GalXC-Placebo+mAb treatments, continued to grow to the same extent. However, the group that received GalXC-STAT3 demonstrated anti-tumor efficacy after the first round of treatment, but they continued to grow despite receiving a second dose. The group that received a combination of GalXC-STAT3 and mAb, demonstrated significantly more tumor regression as compared to the single agent treatment. This demonstrates that combination therapy with a checkpoint inhibitor can achieve improved anti-tumor efficacy.

Figure 18B:
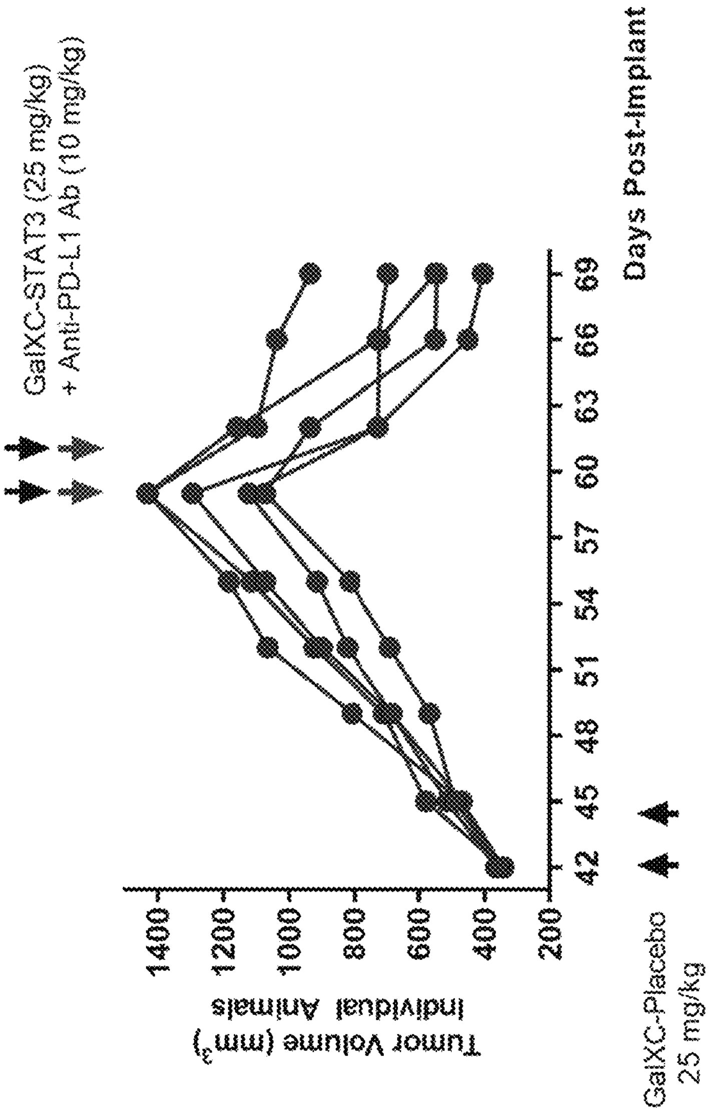
FIG. 18B provides a graph depicting tumor volume after administration of a GalXC-STAT3-C18 oligonucleotide in combination with an anti-PD-L1 mAb. Immunocompetent mice bearing Pan02 murine pancreatic tumors were dosed subcutaneously (s.c.) with 25 mg/kg of GalXC-STAT3-C18-4123 with intraperitoneal (i.p.) treatment of 10 mg/kg of anti-PD-L1 mAb. Mice were administered GalXC-Placebo 42 and 45 days after transplant then administered GalXC-STAT3 in combination with anti-PD-L1 mAb on days 60 and 63.

In a separate study, Pan02 tumors ($2\times10^6$ cells) were implanted in 6-8 week old C57BL/6 mice and upon reaching 300-400 $mm^3$ volume, mice were administered GalXC-Placebo (25 mg/kg) in two doses, three days apart (days 42 and 45). Two weeks later, mice received two doses of GalXC-STAT3-C18-4123 three days apart subcutaneously at 25 mg/kg in combination with anti-PD-L1 mAb (anti-mouse PD-L1 mAb (B7-H1), Clone 10F.9G2) at 10 mg/kg (i.p.). Tumor sizes were measured twice a week throughout the study period. FIG. 18B shows a regression in tumor size following administration of the GalXC-STAT3/PD-L1 mAb combination treatment further demonstrating combination therapy can achieve improved anti-tumor efficacy.

Figures 19A, 19B:
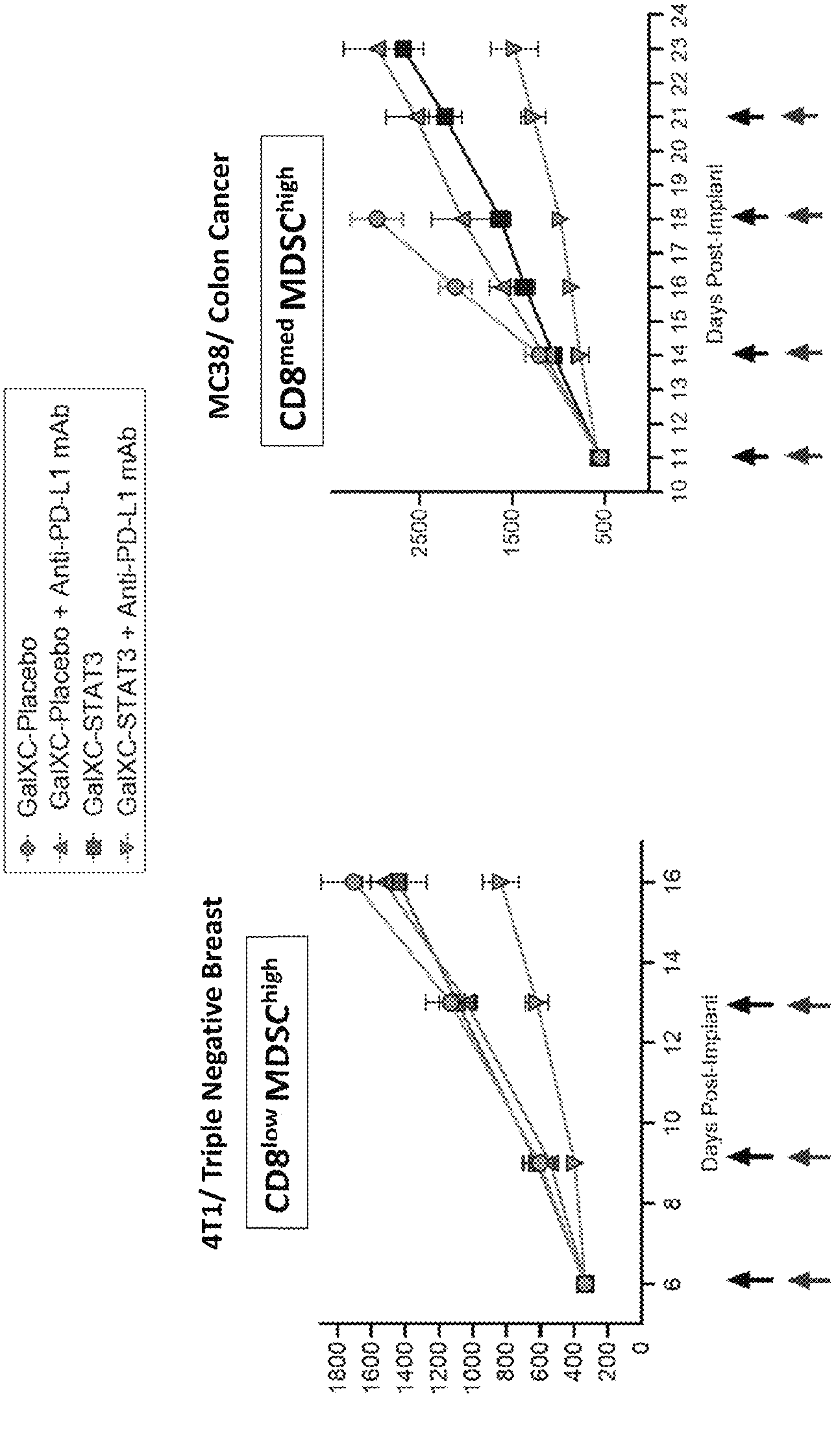
FIGS. 19A-19C provide graphs depicting tumor volume after administration of a GalXC-STAT3-C18 oligonucleotide alone or in combination with an anti-PD-L1 mAb or GalXC-Placebo alone or in combination with anti-PD-L1 mAb in tumors with different immunophenotypes, 4T1 (triple negative breast, checkpoint resistant) (FIG. 19A), MC-38 (Colon carcinoma, partially checkpoint sensitive) (FIG. 19B), or Hepa1-6 (Hepatocellular carcinoma, checkpoint sensitive) (FIG. 19C) cells were implanted into mice. Tumor bearing mice were dosed s.c. with 25 mg/kg of GalXC-STAT3-C18-4123 with i.p. treatment of 10 mg/kg of anti-PD-L1 mAb. Controls included GalXC-Placebo, GalXC-STAT3-C18-4123 at 25 mg/kg or GalXC-Placebo at 25 mg/kg in combination with anti-PD-L1 mAb at 10 mg/kg. Mice bearing MC-38 and Hepa1-6 tumors were administered two doses three days apart at 25 mg/kg and the same regimen was repeated the following week. Mice bearing 4T1 tumors were administered three doses each three days apart (q3d×3). Arrow (5/5 CR)=All mice treated were complete responders.
Figure 19C:
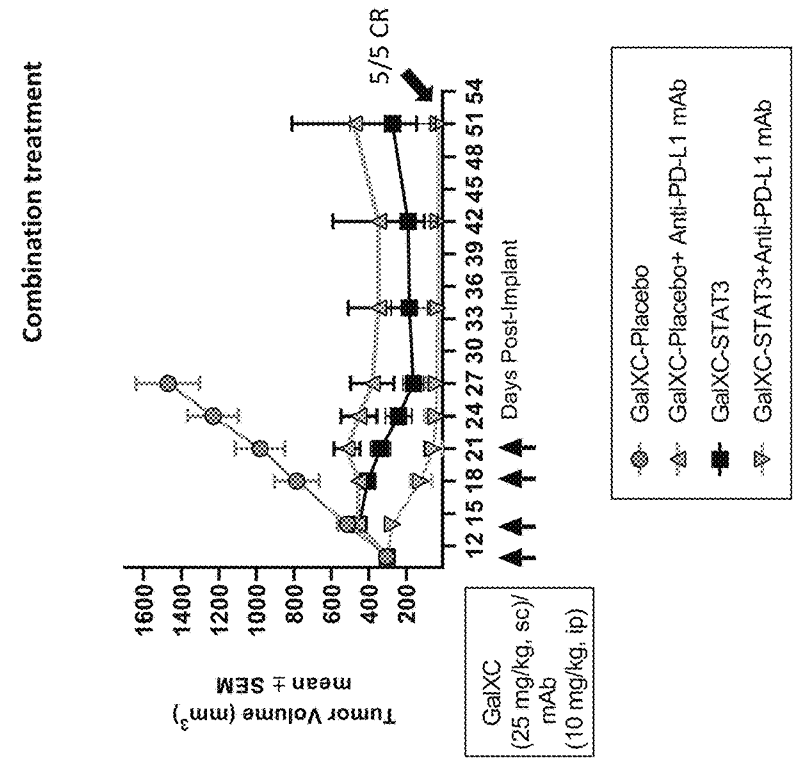

Example 11: Correlation Between Treatment with a Combination of GalXC-STAT3 and PD-L1 mAb with Tumor Immune Phenotypes To ascertain whether the combination efficacy pattern aligns with the tumor immune phenotype, tumor types with different phenotypes were selected for implantation in mice. Selected tumor types included Pan02 (FIG. 18A, checkpoint resistant tumors), 4T1 (triple negative breast, checkpoint resistant tumors), MC-38 (Colon Carcinoma, partially checkpoint sensitive tumors) and Hepa1-6 (Hepatocellular Carcinoma, checkpoint sensitive tumors). Pan02 (5e6 cells+matrigel, FIG. 18A) MC-38 (5e6 cells) and Hepa1-6 tumors (2e6 cells) were grown in C57BL/6 mice (7-8 weeks old) and 4T1 tumors (7-8 weeks old) were grown in Balb/c mice. When each tumor reached the sufficient tumor volume, they were sorted and subjected to treatment, as described in Example 5 (4T1 tumors were treated three times with each dose three days apart (q3d×3), with a combination of subcutaneous GalXC-STAT3-C18-4123 with an anti-PD-L1 mAb or single agents GalXC-Placebo, GalXC-STAT3-C18-4123, or GalXC-Placebo with the mAb, as shown in FIG. 19A. Tumor volumes were measured twice a week throughout the study period. MC-38 and Hepa1-6 tumors were treated with a combination of subcutaneous GalXC-STAT3-C18-4123 with an anti-PD-L1 mAb or single agents GalXC-Placebo, GalXC-STAT3-C18-4123, or GalXC-Placebo with the mAb (2 doses at 3 days apart for 2 weeks) as shown in FIGS. 19B and 19C.

Combination treatment demonstrated synergistic efficacy in the resistant tumor types where the tumors expected to have very little or no CD8+ T cell infiltration in the TME and a larger population of MDSCs ($CD8^{low}$ $MDSC^{high}$) (FIGS. 18 and 19A). The combination treatment showed improved efficacy compared to checkpoint alone treatment in partially sensitive tumors where the tumors had slightly higher levels of CD8+ T-cell infiltration and larger population of MDSCs ($CD8^{med}$ $MDSC^{high}$) (FIG. 19B). Interestingly, the combination treatment led to complete regression of the sensitive tumors ($CD8^{high}$ $MDSC^{high}$) (FIG. 19C). Tumors with higher levels of CD8+ T cell infiltration and MDSCs, when treated with the combination of GalXC-STAT3-C18-4123+anti-PD-L1 mAb, were completely eradicated.

Figure 20:
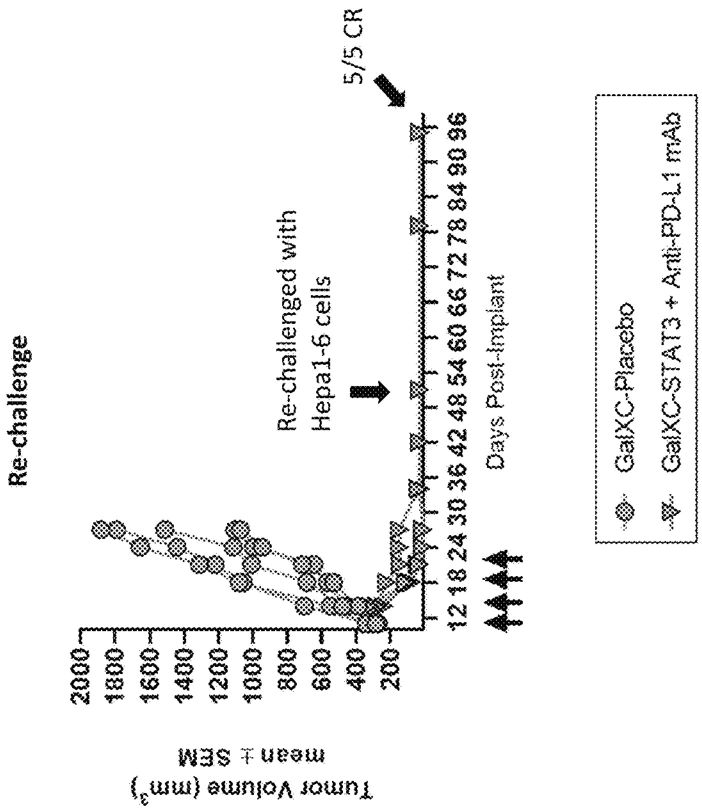
FIG. 20 provides a graph depicting the effect of Hepa1-6 re-challenge in the completely eradicated tumors. After tumors in all 5 mice were completely regressed with the treatment of GalXC-STAT3-C18 (25 mg/kg, s.c.) and anti-PD-L1 mAb (10 mg/kg, i.p.) in FIG. 19C, mice were rechallenged on day 51 with Hepa1-6 cells (2e6 cells/mouse) on the opposite flank of the mice and tumor volume was monitored (FIG. 20). Arrow (5/5 CR)=All mice remained tumor free even after the re-challenge.

Example 12: Treatment Mediated Tumor Regression and Generation of Tumor Specific Memory To evaluate if the combination treatment demonstrating complete regression also led to the generation of memory T-cells in treated mice, tumors that were completely regressed in FIG. 19C were re-challenged with Hep1-6 cells (2e6 cells) on the opposite flank of the mice on day 51. As shown in FIG. 20, even after the re-challenge, all mice remained tumor-free and survived for the period that they were kept and maintained (~2 months). These data demonstrate strong therapeutic antitumor efficacy of combination treatment leading to long term immunological memory.

Figures 21A, 21B:
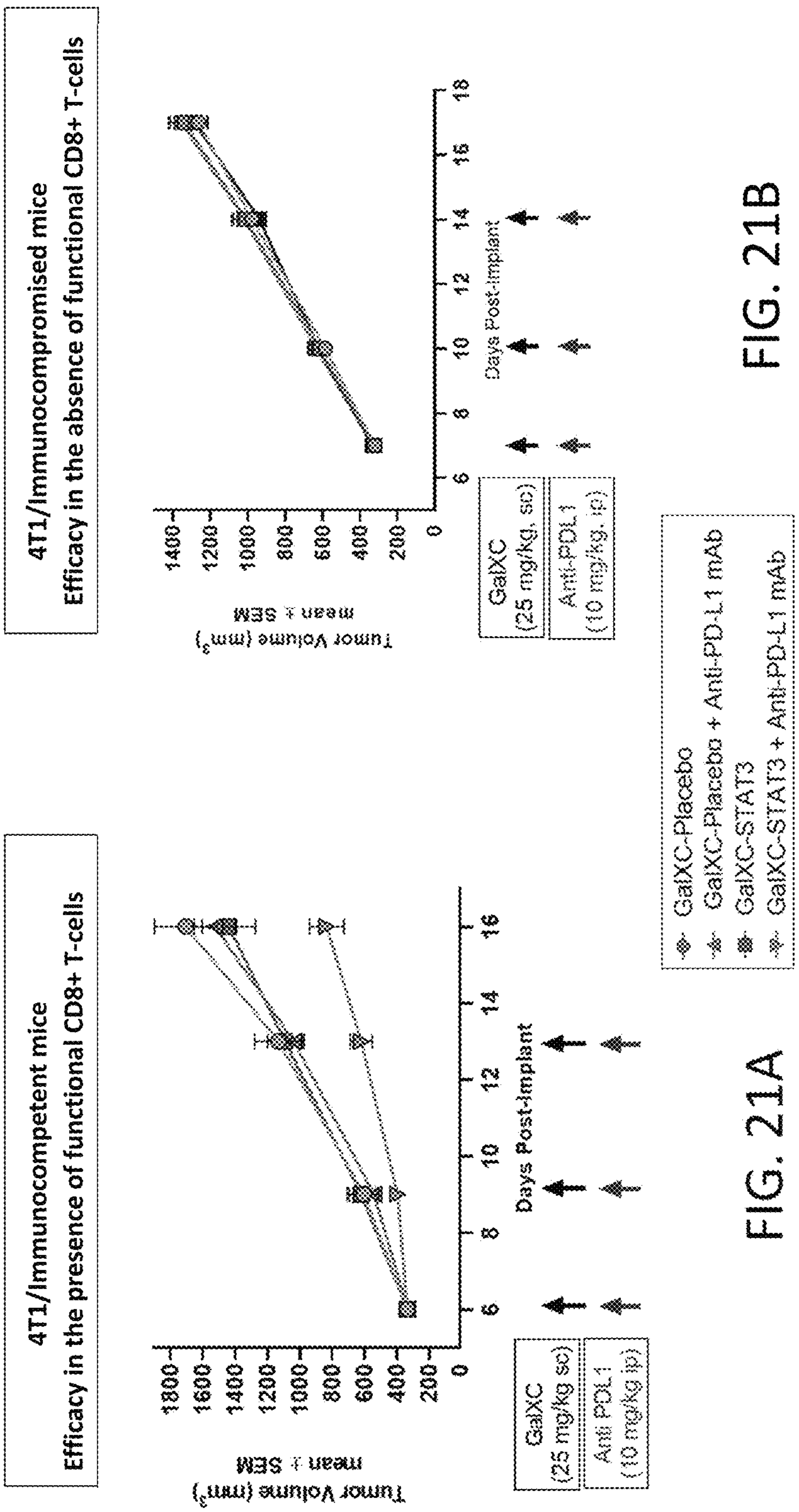
FIGS. 21A and 21B provide graphs depicting tumor volume after administration of GalXC-STAT3-C18 oligonucleotide alone or in combination with an anti-PD-L1 mAb in immunocompetent mice with functional CD8+ T cells (FIG. 21A) and immunocompromised mice with no functional CD8+ T cells (FIG. 21B). Mice (immunocompetent or immunocompromised) bearing 4T1 tumors were dosed s.c. with GalXC-STAT3-C18-4123 (25 mg/kg, three times with each dose three days apart (q3d×3)) and i.p. with anti-PD-L1 mAb (10 mg/kg, q3d×3). Controls included GalXC-Placebo, GalXC-STAT3-C18-4123 at 25 mg/kg or GalXC-Placebo at 25 mg/kg in combination with anti-PD-L1 mAb at 10 mg/kg.
Figure 22:
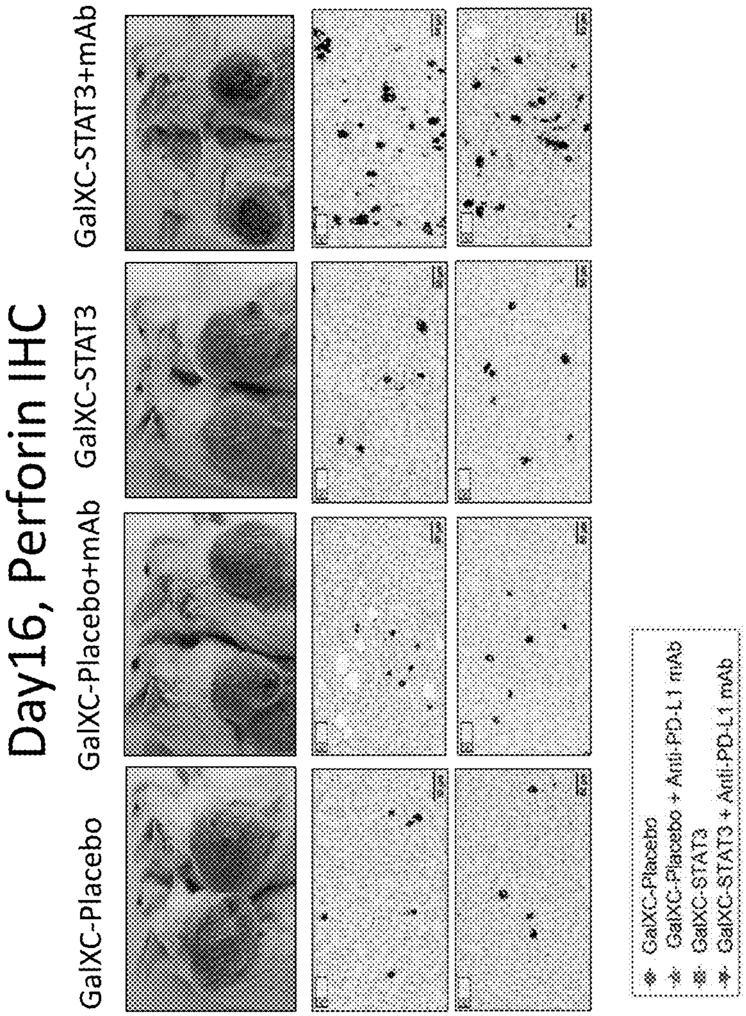
FIG. 22 provides images showing the appearance of tumors (with cell death) from mice assayed in FIG. 21A, and perforin staining for positive cytotoxic CD8+ T cells in the tumors at the end of the study.

Example 13: CD8+ T Cell Mediated Combination Efficacy is Also Perforin Dependent To evaluate if the efficacy mediated by the combination treatment was CD8+ T cell mediated, an efficacy study was performed using 4T1 tumors (2e6 cells) in immunocompetent Balb/c mice (7-8 weeks old) as described in Example 7. The experiment was repeated in immunocompromised nude mice bearing 4T1 tumors. As shown in FIG. 21A, there was synergistic efficacy with combination treatment of GalXC-STAT3-C18-4123 plus anti-PD-L1 mAb in tumor bearing immunocompetent mice, but no efficacy observed in nude mice bearing 4T1 tumors (FIG. 21B), suggesting that there is a key role for CD8+ T cells in mediating anti-tumor efficacy. To confirm that efficacy is mediated by cytotoxic CD8+ T cells, tumor samples from the terminal timepoint of the study were stained for perforin. A significantly larger population of perforin positive cells in the tumors that received combination treatment, as shown in FIG. 22, shows that the T cells involved in mediating efficacy were cytotoxic in nature.

Figure 23:
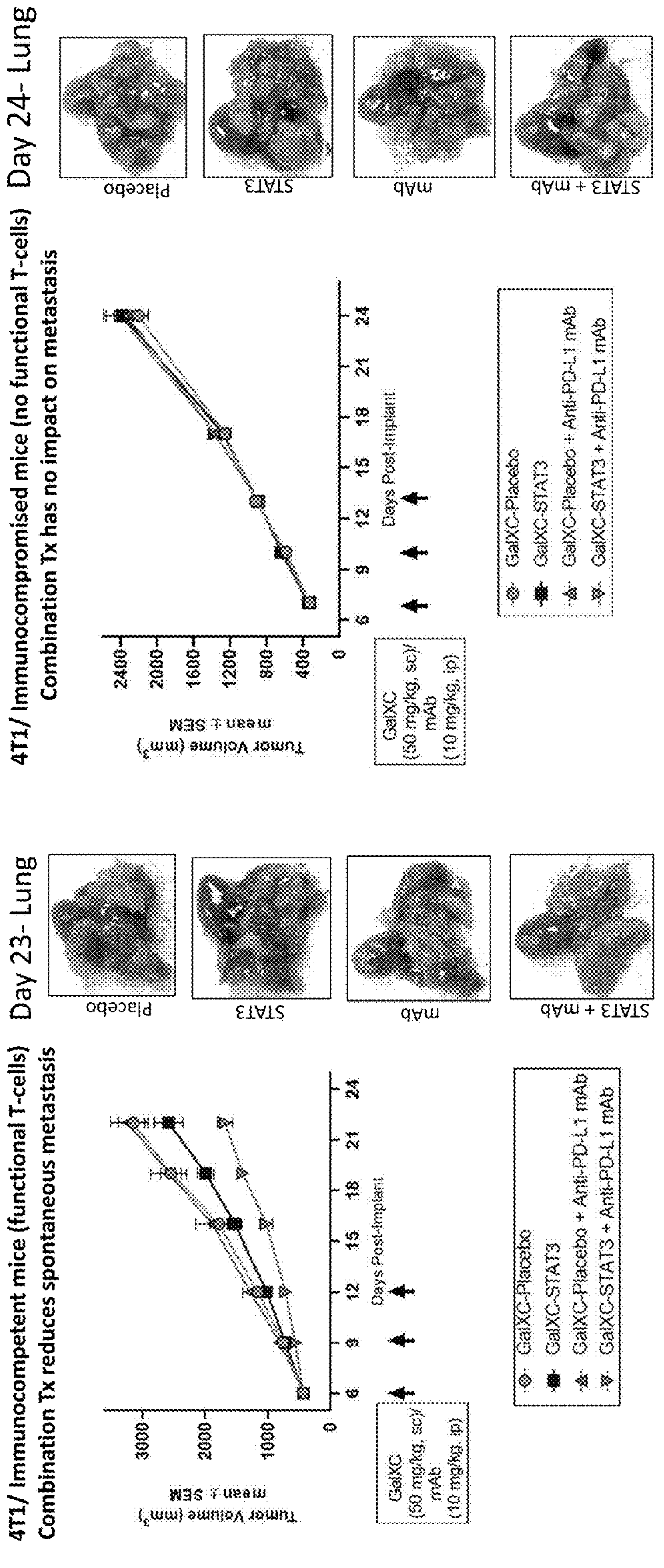
FIG. 23 provides graphs depicting tumor volume and images showing lung tumor metastasis after administration of GalXC-STAT3-C18-4123 oligonucleotide alone or in combination with an anti-PD-L1 mAb. Mice (immunocompetent or immunocompromised) bearing 4T1 tumors were dosed s.c. with GalXC-STAT3-C18-4123 (50 mg/kg, q3d×3) and i.p. with anti-PD-L1 mAb (10 mg/kg, q3d×3). Controls included GalXC-Placebo, GalXC-STAT3-C18-4123 at 50 mg/kg or GalXC-Placebo at 50 mg/kg in combination with anti-PD-L1 mAb at 10 mg/kg.

Example 14: Effect of Combination Treatment on Spontaneous Tumor Metastasis in a Highly Metastatic Tumor Model To evaluate whether combination treatment reduces the metastasis in a spontaneous metastatic tumor model, 4T1 tumors (2e6 cells/mouse) were implanted in Balb/c mice (7-8 weeks old) as described in Example 7. When tumors reached the size of 500 $mm^3$, they were treated with GalXC-Placebo, GalXC-STAT3-C18-4123, GalXC-Placebo+anti-PD-L1 mAb or GalXC-STAT3+anti-PD-L1 mAb (q3d×3, GalXC oligonucleotides administered at 50 mg/kg and anti-PD-L1 mAb administered at 10 mg/kg) and the tumors were monitored for tumor growth. Twelve days after the last dose, mice were sacrificed, and lungs were photographed. As shown in FIG. 23, lungs from single agent or placebo treatments showed tumor metastases throughout the whole organ whereas the mice administered the combination treatment (GalXC-STAT3-C18-4123+anti-PD-L1 mAb) showed no visible metastases in the lungs of all five mice, suggesting that the treatment not only reduced the local tumor growth as shown in the figure, but also reduced the spontaneous metastases to lung. The same experiment was repeated in nude mice also shown in FIG. 23. All the lungs, including those from the mice that received the combination treatment had tumor metastases, further confirming the role of CD8+ T cells in anti-tumor efficacy.

Example 15: Treatment Mediated Immune Modulation in Tumors

To understand how the combination treatment of GalXC-STAT3-C18-4123 with an anti-PD-L1 mAb changes the immune profile in tumor, CT26 tumors were implanted in Balb/c mice. These tumors are partially sensitive to checkpoint inhibitors and have the profile similar to MC38 ($CD8^{med}$ $MDSC^{med/high}$). When the tumors reached a sufficient size, they were treated with GalXC-Placebo, GalXC-STAT3-C18-4123, GalXC-Placebo+anti-PD-L1 mAb, or GalXC-STAT3-C18-4123+anti-PD-L1 mAb (q3d×2, 25 mg/kg or 10 mg/kg). Seven days post last dose, tumors were collected, subjected to homogenization, and nanostring analysis was performed (mRNA extracted from paraffin embedded samples and mRNA expression was analyzed via the ncounter$^R$Mouse Pancancer IO 360™ Panel (Nanostring Technologies, Seattle, WA).

Figure 24:
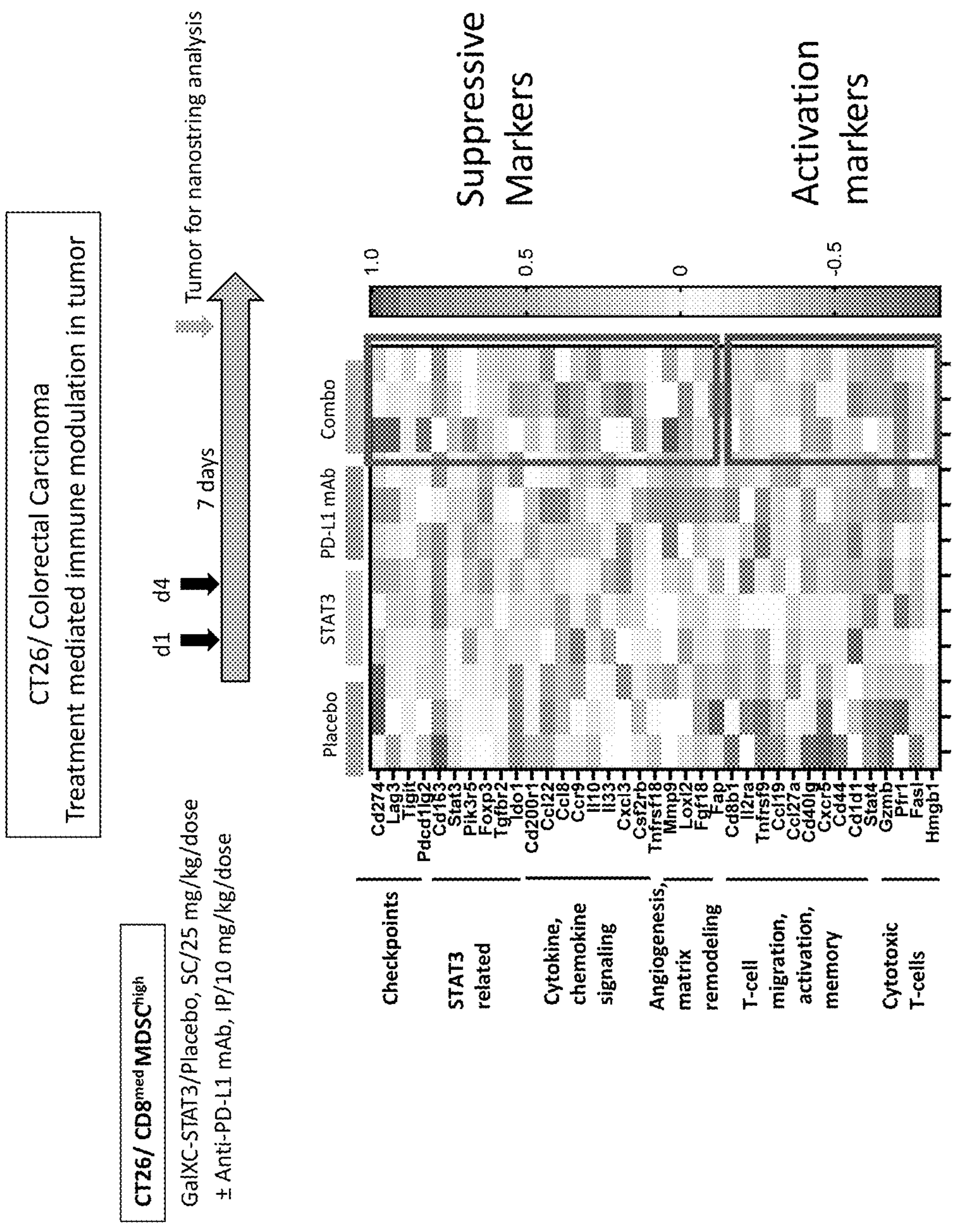
FIG. 24 provides a heat map showing the regulation of targets involved in immune modulation observed in CT26 tumors upon combination treatment of GalXC-STAT3-C18-4123 (s.c, 25 mg/kg, q3d×3) and anti-PD-L1 mAb (i.p. at 10 mg/kg, q3d×3) compared to controls including GalXC-Placebo, GalXC-STAT3-C18-4123 at 25 mg/kg or GalXC-Placebo at 25 mg/kg in combination with anti-PD-L1 mAb at 10 mg/kg.

The analysis showed that the genes that are suppressive in nature (checkpoints, STAT3 mediated genes, suppressive cytokine/chemokines, angiogenesis & matrix remodeling related genes) were reduced and genes that favor T-cell activation (genes that involve in T-cell migration, activation, memory and cytotoxicity) increased after the combination treatment compared to the single agent or GalXC-Placebo, anti-PD-L1 mAb treatments suggesting that the combination treatment is changing the TME from suppressive to a favorable TME for T-cell infiltration (FIG. 24).

Example 16: STAT3 Oligonucleotides for Treatment of Disease

Figure 25:
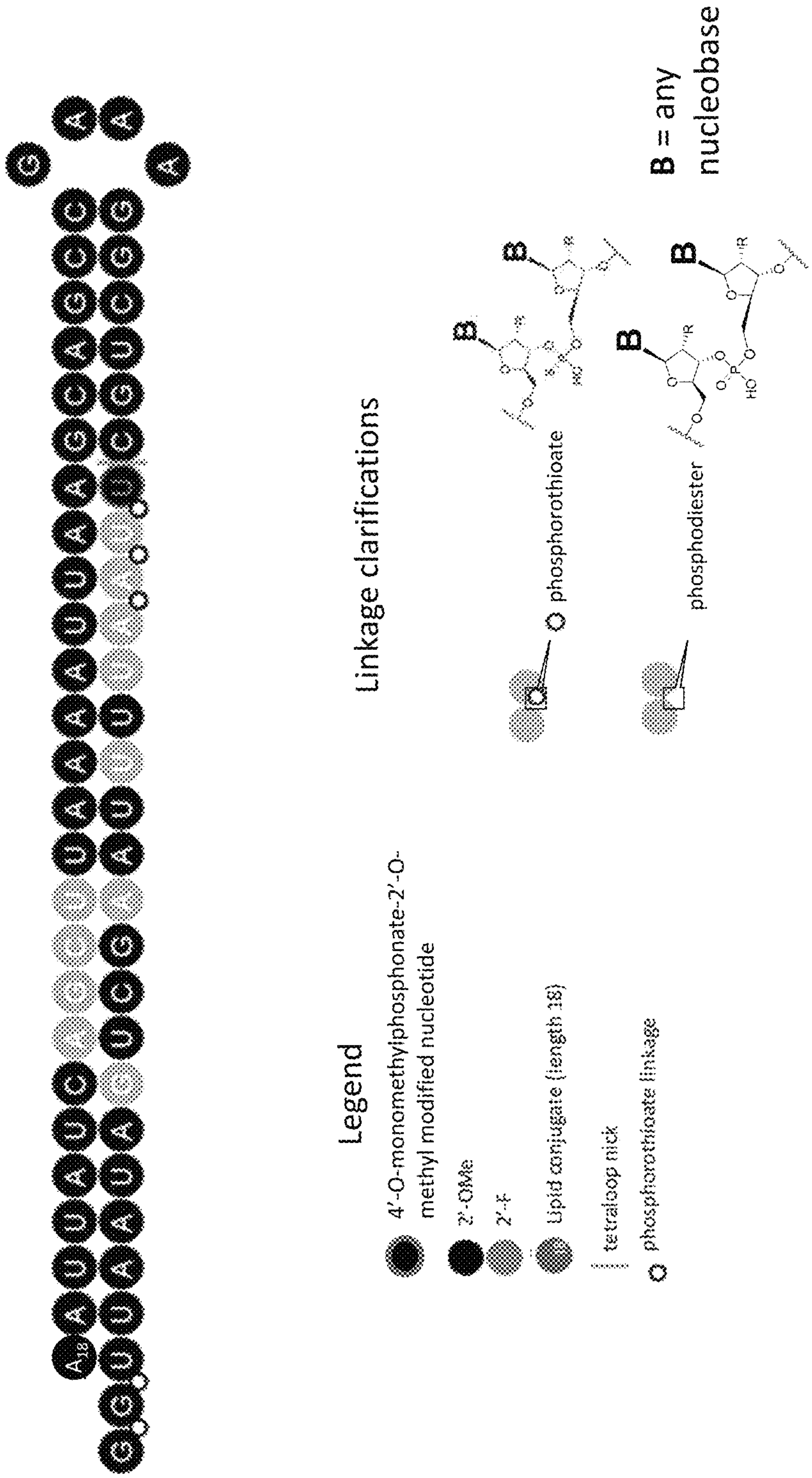
FIG. 25 provides the structure of an RNAi oligonucleotide molecule having chemical modifications with a C18 lipid conjugated to the 5' terminal nucleotide of the sense strand to generate an oligonucleotide-ligand conjugate. The oligonucleotide is representative of the sense strand of SEQ ID NO: 1055 and the antisense strand of SEQ ID NO: 1145.
Figure 26A:
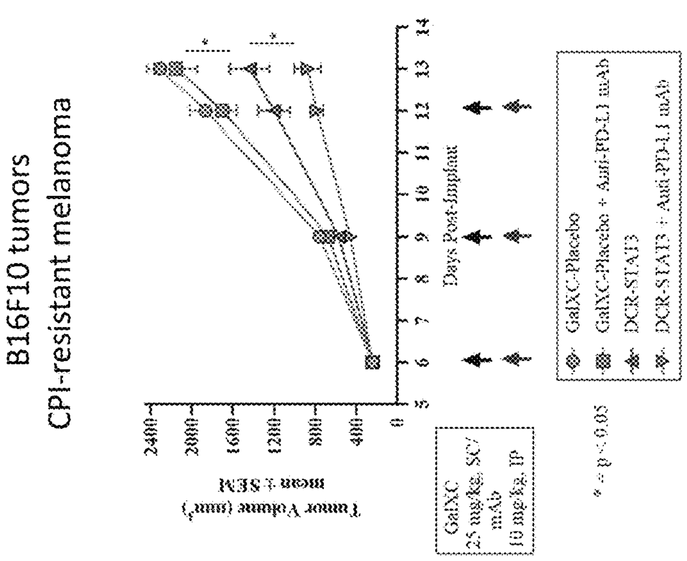
FIGS. 26A-26C provide graphs depicting tumor volume after administration of DCR-STAT3, (a human specific STAT3 sequence with C18 lipid conjugation at 5'end of the passenger strand corresponding to SEQ ID NOs: 1222 and 1145) or GalXC-Placebo (a chemically matched irrelevant sequence that does not bind Stat3/STAT3 mRNA target sequence) alone or in combination with an anti-PD-L1 antibody. Immunocompetent mice bearing B16F10 (murine melanoma), Pan02 (murine pancreatic) and MC-38 (murine colorectal) tumors were treated with either three or four subcutaneous (s.c.) doses of 25 mg/kg of the conjugated oligonucleotide either alone or in combination with 10 mg/kg intraperitoneal (i.p.) of anti-PD-L1 antibody. B16F10 tumor bearing mice were administered three doses three days apart, Pan02 tumor bearing mice were first administered 2 doses 3 days apart and a week later, were administered two more doses three days apart. MC-38 tumor bearing mice were first administered 2 doses 3 days apart and four days later, were administered two more doses three days apart. Arrows indicate days doses were administered.
Figure 26B:
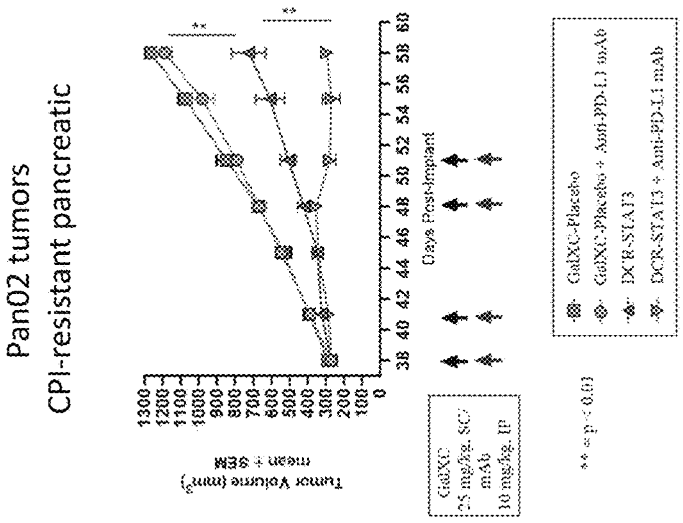
Figure 26C:
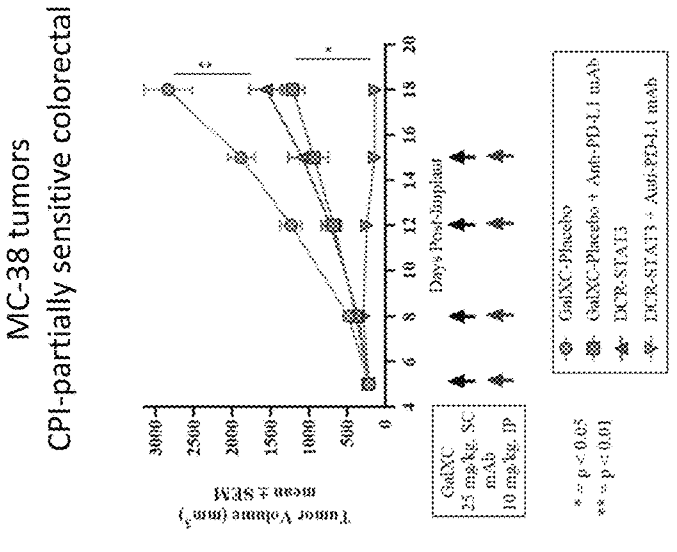

To investigate efficacy of STAT3 oligonucleotides alone or in combination with an anti-PD-L1 mAb, subjects are administered a STAT3 oligonucleotide or a STAT3 oligonucleotide in combination with an anti-PD-L1 mAb. Specifically, subjects are administered a STAT3 oligonucleotide wherein the sense strand comprises the sequence set forth in SEQ ID NO: 1222, and wherein the antisense strand comprises the sequence set forth in SEQ ID NO: 1145 as illustrated below (depicted in FIG. 25):

```
Sense Strand:
[ademAs-C18][mA][mU][mU][mA][mU][mC][fA][fG][fC]

[fU][mU][mA][mA][mA][mA][mU][mU][mA][mA][mG][mC]

[mA][mG][mC][mC][mG][mA][mA][mA]
Hybridized to:

Antisense Strand:
[MePhosphonate-4O-mUs][fUs][fAs][fA][fU][mU][fU]

[mU][mA][fA][mG][mC][mU][fG][mA][mU][mA][mA][mU]

[mUs][mGs][mG]
```

(key provided in Table 7)

The STAT3 oligonucleotide described above is administered alone or in combination with an anti-PD-L1 antibody. The STAT3 oligonucleotide is administered prior to, concurrently with, or after administration of the anti-PD-L1 antibody. Following administration, tumor size and subject survival are measured.

Example 17: STAT3 Inhibition in Combination with Checkpoint Inhibition Significantly Improves Anti-Tumor Efficacy Studies were conducted in 3 different mouse tumor models, B16F10, Pan02 and MC-38. B16F10 and Pan02 are murine melanoma and pancreatic cancer models that are thought to be resistant to checkpoint inhibitors (CPI) due to the presence of a large population myeloid-derived suppressor cells (MDSC) and little or no CD8+ T-cells in the tumor microenvironment (TME). The MC-38 tumor model is a murine colon carcinoma model known to be partially sensitive to CPI and carries modest levels of MDSCs and CD8+ T-cells in its TME. The experiment described in this example was designed to evaluate the efficacy of the DCR-STAT3 (a human specific STAT3 sequence with C18 lipid conjugation at 5'end of the passenger strand corresponding to SEQ ID NOs: 1222 and 1145, "DCR-STAT3") in CPI-resistant and sensitive preclinical models.

Mice were administered either GalXC-Placebo or DCR-STAT3 with and without a anti-PD-L1 mouse antibody. The GalXC-Placebo and DCR-STAT3 were administered subcutaneously at 25 mg/kg and the anti-PD-L1 antibody was administered intraperitoneally at 10 mg/kg. In the B16F10 tumor model, doses were administered on Days 6 (6 days post tumor implant), 9, and 12. In the Pan02 model, doses were administered on Days 38 (38 days post tumor implant), 41, 48 and 51. In the MC-38 tumor model, doses were administered on Days 5 (5 days post tumor implant), 8, 12, and 15.

In the CPI-resistant B16F10 model, following 3 doses of DCR-STAT3 or DCR-STAT3+anti-PD-L1 antibody, tumor sizes on Day 13 were reduced by 36% ($p<0.01$) and 64% ($p<0.0001$), respectively, relative to the GalXC-Placebo group. The anti-PD-L1 antibody alone had no effect on tumor growth and tumors grew to the same size as the GalXC-Placebo group. The tumor sizes in the combination group (DCR-STAT3+anti-PD-L1 antibody) were reduced by 43% ($p<0.05$) relative to DCR-STAT3 alone, and 64% ($p<0.0001$) relative to anti-PD-L1 antibody alone. Similar pattern was observed in Pan02 study as well. Following 4 doses of DCR-STAT3 or DCR-STAT3+anti-PD-L1 antibody, tumor sizes on Day 58 were reduced by 39% ($p<0.01$) and 75% ($p<0.0001$) respectively relative to control group. The anti-PD-L1 antibody had no effect on tumor growth and tumors grew to the same size as the GalXC-Placebo group. The tumor sizes in the combination group were reduced by 59% ($p<0.01$) relative to DCR-STAT3 alone and 76% ($p<0.0001$) relative to anti-PD-L1 antibody alone suggesting that the DCR-STAT3 was active as single agent, and the single agent activity was further enhanced when it was combined with the antibody in this CPI resistant tumor models.

In the CPI partially sensitive MC-38 model, following 4 doses of anti-PD-L1 antibody or DCR-STAT3, tumor sizes on Day 18 were reduced by 57% ($p<0.01$) and 45% ($p<0.01$) respectively, relative to the GalXC-Placebo group. On Day 18, following 4 doses of DCR-STAT3+anti-PD-L1 antibody, tumor sizes were reduced by 95% ($p<0.0001$), relative to the GalXC-Placebo group. Compared to the anti-PD-L1 antibody or DCR-STAT3, tumor sizes were reduced by 89% ($p<0.05$) and 91%, ($p<0.01$), respectively, in DCR-STAT3+anti-PD-L1 antibody group. Administration of either the anti-PD-L1 antibody or DCR-STAT3 were both active as single agents, but the combination of both further enhanced the efficacy of either single agent.

The data from these 3 experiments provide evidence that DCR-STAT3 was active as single agent in CPI-resistant tumors where the anti-PD-L1 antibody was inactive and when DCR-STAT3 was combined with the anti-PD-L1 antibody, it led to synergistic anti-tumor activity. DCR-STAT3 was also active in CPI-sensitive tumors where anti-PD-L1 also demonstrated single-agent activity, and when used in combination, majority of the tumors regressed by nearly 100%.

SEQUENCE LISTING

| Name | Description | Species | Sequence | SEQ ID NO |
|---|---|---|---|---|
| Forward 2 | | | GATGATTTCAGCAAATGACATGTTG | 1 |
| Reverse 2 | | | CAGTGAAAGCAGCAAAGAAGG | 2 |
| Probe 2 | | | /56-FAM/AGGACATCA/ZEN/GCGGTAAGACCCAGA/3IABKFQ/ | 3 |

-continued

SEQUENCE LISTING

| Name | Description | Species | Sequence | SEQ ID NO |
|---|---|---|---|---|
| STAT3-721 | Modified 22 mer | | [MePhosphonate-4O-mUs][fAs][fU][fA][fG][<br>mU][fU][mG][mA][fA][mA][mU][mC][fA][mA][<br>mA][mG][mU][mC][mAs][mGs][mG] | 4 |
| STAT3-1286 | Modified 22 mer | | [MePhosphonate-4O-mUs][fUs][fA][fA][fU][<br>mU][fU][mU][mA][fA][mG][mC][mU][fG][mA][<br>mU][mA][mA][mU][mUs][mGs][mG] | 5 |
| STAT3-1287 | Modified 22 mer | | [MePhosphonate-4O-mUs][fUs][fU][fA][fA][<br>mU][fU][mU][mU][fA][mA][mG][mC][fU][mG][<br>mA][mU][mA][mA][mUs][mGs][mG] | 6 |
| STAT3-1388 | Modified 22 mer | | [MePhosphonate-4O-mUs][fAs][fUs][fU][fC]<br>[mU][fU][mC][mC][fA][mU][mG][mU][fU][mC]<br>[mA][mU][mC][mA][mCs][mGs][mG] | 7 |
| NM_213659.3<br>*Musmusculus*<br>STAT3<br>nucleotide<br>sequence | | | AATTATGCATGGAGGCGTGTCTTGGCCAGTGGCGGCTGGG<br>TGGGGATTGGCTGGAGGGGCTGTAATTCAGCGGTTTCCGG<br>AGCTGCAGTGTAGACAGGGAGGGGGAACCTGGGGTTCCGA<br>CGTCGCGGCGGAGGGAACGAGCCCTAACCGGATCGCTGAG<br>GTACAACCCCGCTCGGTGTCGCCTGACCGCGTCGGCTAGG<br>AGAGGCCAGGCGGCCCTCGGGAGCCCAGCAGCTCGCGCCT<br>GGAGTCAGCGCAGGCCGGCCAGTCGGGCCTCAGCCCCGGA<br>GACAGTCGAGACCCCTGACTGCAGCAGGATGGCTCAGTGG<br>AACCAGCTGCAGCAGCTGGACACACGCTACCTGGAGCAGC<br>TGCACCAGCTGTACAGCGACAGCTTCCCCATGGAGCTGCG<br>GCAGTTCCTGGCACCTTGGATTGAGAGTCAAGACTGGGCA<br>TATGCAGCCAGCAAAGAGTCACATGCCACGTTGGTGTTTC<br>ATAATCTCTTGGGTGAAATTGACCAGCAATATAGCCGATT<br>CCTGCAAGAGTCCAATGTCCTCTATCAGCACAACCTTCGA<br>AGAATCAAGCAGTTTCTGCAGAGCAGGTATCTTGAGAAGC<br>CAATGGAAATTGCCCGGATCGTGGCCCGATGCCTGTGGGA<br>AGAGTCTCGCCTCCTCCAGACGGCAGCCACGGCAGCCCAG<br>CAAGGGGGCCAGGCCAACCACCCAACAGCCGCCGTAGTGA<br>CAGAGAAGCAGCAGATGTTGGAGCAGCATCTTCAGGATGT<br>CCGGAAGCGAGTGCAGGATCTAGAACAGAAAATGAAGGTG<br>GTGGAGAACCTCCAGGACGACTTTGATTTCAACTACAAAA<br>CCCTCAAGAGCCAAGGAGACATGCAGGATCTGAATGGAAA<br>CAACCAGTCTGTGACCAGACAGAAGATGCAGCAGCTGGAA<br>CAGATGCTCACAGCCCTGGACCAGATGCGGAGAAGCATTG<br>TGAGTGAGCTGGCGGGGCTCTTGTCAGCAATGGAGTACGT<br>GCAGAAGACACTGACTGATGAAGAGCTGGCTGACTGGAAG<br>AGGCGGCAGCAGATCGCGTGCATCGGAGGCCCTCCCAACA<br>TCTGCCTGGACCGTCTGGAAAACTGGATAACTTCATTAGC<br>AGAATCTCAACTTCAGACCCGCCAACAAATTAAGAAACTG<br>GAGGAGCTGCAGCAGAAAGTGTCCTACAAGGGCGACCCTA<br>TCGTGCAGCACCGGCCCATGCTGGAGGAGAGGATCGTGGA<br>GCTGTTCAGAAACTTAATGAAGAGTGCCTTCGTGGTGGAG<br>CGGCAGCCCTGCATGCCCATGCACCCGGACCGGCCCTTAG<br>TCATCAAGACTGGTGTCCAGTTTACCACGAAAGTCAGGTT<br>GCTGGTCAAATTTCCTGAGTTGAATTATCAGCTTAAAATT<br>AAAGTGTGCATTGATAAAGACTCTGGGGATGTTGCTGCCC<br>TCAGAGGGTCTCGGAAATTTAACATTCTGGGCACGAACAC<br>AAAAGTGATGAACATGGAGGAGTCTAACAACGGCAGCCTG<br>TCTGCAGAGTTCAAGCACCTGACCCTTAGGGAGCAGAGAT<br>GTGGGAATGGAGGCCGTGCCAATTGTGATGCCTCCTTGAT<br>CGTGACTGAGGAGCTGCACCTGATCACCTTCGAGACTGAG<br>GTGTACCACCAAGGCCTCAAGATTGACCTAGAGACCCACT<br>CCTTGCCAGTTGTGGTGATCTCCAACATCTGTCAGATGCC<br>AAATGCTTGGGCATCAATCCTGTGGTATAACATGCTGACC<br>AATAACCCCAAGAACGTGAACTTCTTCACTAAGCCGCCAA<br>TTGGAACCTGGGACCAAGTGGCCGAGGTGCTCAGCTGGCA<br>GTTCTCGTCCACCACCAAGCGGGGGCTGAGCATCGAGCAG<br>CTGACAACGCTGGCTGAGAAGCTCCTAGGGCCTGGTGTGA<br>ACTACTCAGGGTGTCAGATCACATGGGCTAAATTCTGCAA<br>AGAAAACATGGCTGGCAAGGGCTTCTCCTTCTGGGTCTGG<br>CTAGACAATATCATCGACCTTGTGAAAAAGTATATCTTGG<br>CCCTTTGGAATGAAGGGTACATCATGGGTTTCATCAGCAA<br>GGAGCGGGAGCGGGCCATCCTAAGCACAAAGCCCCCGGGC<br>ACCTTCCTACTGCGCTTCAGCGAGAGCAGCAAAGAAGGAG<br>GGGTCACTTTCACTTGGGTGGAAAAGGACATCAGTGGCAA<br>GACCCAGATCCAGTCTGTAGAGCCATACACCAAGCAGCAG | 8 |

-continued

SEQUENCE LISTING

| Name | Description | Species | Sequence | SEQ ID NO |
|---|---|---|---|---|
| | | | CTGAACAACATGTCATTTGCTGAAATCATCATGGGCTATA AGATCATGGATGCGACCAACATCCTGGTGTCTCCACTTGT CTACCTCTACCCCGACATTCCCAAGGAGGAGGCATTTGGA AAGTACTGTAGGCCCGAGAGCCAGGAGCACCCCGAAGCCG ACCCAGGTAGTGCTGCCCCGTACCTGAAGACCAAGTTCAT CTGTGTGACACCAACGACCTGCAGCAATACCATTGACCTG CCGATGTCCCCCCGCACTTTAGATTCATTGATGCAGTTTG GAAATAACGGTGAAGGTGCTGAGCCCTCAGCAGGAGGGCA GTTTGAGTCGCTCACGTTTGACATGGATCTGACCTCGGAG TGTGCTACCTCCCCCATGTGAGGAGCTGAAACCAGAAGCT GCAGAGACGTGACTTGAGACACCTGCCCCGTGCTCCACCC CTAAGCAGCCGAACCCCATATCGTCTGAAACTCCTAACTT TGTGGTTCCAGATTTTTTTTTTTAATTTCCTACTTCTGCT ATCTTTGGGCAATCTGGGCACTTTTTAAAATAGAGAAATG AGTGAGTGTGGGTGATAAACTGTTATGTAAAGAGGAGAGC ACCTCTGAGTCTGGGGATGGGGCTGAGAGCAGAAGGGAGC AAGGGGAACACCTCCTGTCCTGCCCGCCTGCCCTCCTTTT TCAGCAGCTCGGGGTTGGTTGTTAGACAAGTGCCTCCTGG TGCCCATGGCATCCTGTTGCCCCACTCTGTGAGCTGATAC CCCAGGCTGGGAACTCCTGGCTCTGCACTTTCAACCTTGC TAATATCCACATAGAAGCTAGGACTAAGCCCAGAGGTTCC TCTTTAAATTAAAAAAAAAAAAAATAAGAATTAAAGGGCA AAACACACTGACACAGCATAGCCTTTCCATATCAAGGAAT ACTCAGTTAACAGCCTCTCCAGCGCTGTCTTCAGGCTGAT CATCTATATAAACCCTGGAATGGTTGCAGATCAAATCTGT AAAAGAGATCCGAGAGCTGTGGCTTGGCCTCTGGTTCAAA CACAAAGGCTAGAGAGAACCTAGATATCCCTGGGTTTTGT TTACCCAGTATGCTTGTCGGTTGGAGGTGTGAGGTAGGCC AAGGGCACTGGAAAGCCTTTGTCATCACCCTACTCCCTCC CCAACCCAGACTCCAGACCCTGTTTCAGGGTCAGCCTGCC CTGTGGGTGCCTTACTGGGCCTAGGGTCAACCTGCCTTCC TTTCCCACTTGACCTTGCTGGTAGTATGTCCCCTTCCCAT GTCCAAAGGCCCTCTGTCCTGCTTCTATTGGGAATCCCTG CCTCAGGACCTTGTGTCGAGAGGGATTGCCTTACAGGTTT GAACCTGCCTCAGACTACAGGCCCTCAGCAAAGCTCAGGG AGTATGGTCCTTATTCTATGCGCTTGGTTCCCAGGGATAT CTGTAACCACAGGGCAAAAGCTGACATATACTCCAGGTCT GCCCTCATATGAGTGGTGTATTCTTGGCCTCCCCTGAGAC TGGCAACTGTCTGCTCCCCATTGGGTCTCCCAGGTGAGGT GGAACACAGTTCCTGCACCTACTGTGGCCTCCATGTCGCT TGCTTGCTTCGCTCACTCAGCTTACTGGAACACTGAGTGT TCAAGGCAAGCCTTTCCTGACAGAGGCATGGCTAGATTCA GTGACTCAAAGCCACCTCATTCAGCTGATCAGTGTCTGTG GAATTGTTTCCTTCCAGTTAACCAGTGTCTGAATTAAGGG CAGTGAGGACATTGTCTCCAAGACGAACTGCTTGCCTTGA CCACCCCAGCCTTCTGCTTCGAGACAGTTACTGCTCTCCC ACCCCATCAATGTTCTTTAGTTATACAATAAGCTGAACTT ATAAACTGAAAGGGTATTTAGGAAGGCAAGGCTTGGGCAT TTTTATGGCTTTCAATCCTGGGGACCCAGGAACAAGGTGA GGGCTTCTCTGGGGCTGGTGTTGTACCTCAGGGGCTCTGG GAAGTCTGTGTGCCTGGGTTAACCACCCATAGTGAGCCCC TGGAACTGCCCACTTTCCCTCTCCTTGGCCCCACTTGGCC CCAGCCTCACCCAGCCTGCAGACTGCTTAGCCTTTCAGTG CAGTGGCTTGTGTTCTGGCCACTGCACTCAGATTCCAATG TAAACTTTCTAGTGTAAAAATTTATATTATTGTGGGTTGT TTTTTGTTGTTGTTTGTTTTTGTATATTGCTGTAACTACT TTAACTTCCAGAAATAAAGATTATATAGGAACTGTCTGGC | |
| GalXC-STAT3-838 | UnModified 36 mer | | AGGACGACUUUGAUUUCAAAGCAGCCGAAAGGCUGC | 9 |
| GalXC-STAT3-838 | UnModified 22 mer | | UUUGAAAUCAAAGUCGUCCUGG | 10 |
| GalXC-STAT3-838 | Modified 36 mer | | [mAs][mG][mG][mA][mC][mG][mA][fC][fU][fU ][fU][mG][mA][mU][mU][mU][mC][mA][mA][mA ][mG][mC][mA][mG][mC][mC][mG][ademA-GalN Ac][ademA-GalNAc][ademA-GalNAc][mG][mG][ mC][mU][mG][mC] | 11 |
| GalXC-STAT3-838 | Modified 22 mer | | [MePhosphonate-4O-mUs][fUs][fU][fG][fA][ mA][fA][mU][mC][fA][mA][mA][mG][fU][mC][ mG][mU][mC][mC][mUs][mGs][mG] | 12 |

-continued

SEQUENCE LISTING

| Name | Description | Species | Sequence | SEQ ID NO |
|---|---|---|---|---|
| GalXC-STAT3-1390 | UnModified 36 mer | | UCAAAUUUCCUGAGUUGAAAGCAGCCGAAAGGCUGC | 13 |
| GalXC-STAT3-1390 | UnModified 22 mer | | UUUCAACUCAGGAAUUUGAGG | 14 |
| GalXC-STAT3-1390 | Modified 36 mer | | [mUs][mC][mA][mA][mA][mU][mU][fU][fC][fC][fU][mG][mA][mG][mU][mU][mG][mA][mA][mA][mG][mC][mA][mG][mC][mC][mG][ademA-GalNAc][ademA-GalNAc][ademA-GalNAc][mG][mG][mC][mU][mG][mC] | 15 |
| GalXC-STAT3-1390 | Modified 22 mer | | [MePhosphonate-4O-mUs][fUs][fU][fC][fA][mA][fC][mU][mC][fA][mG][mG][mA][fA][mA][mU][mU][mU][mG][mAs][mGs][mG] | 16 |
| GalXC-STAT3-1394 | UnModified 36 mer | | AUUUCCUGAGUUGAAUUAUAGCAGCCGAAAGGCUGC | 17 |
| GalXC-STAT3-1394 | UnModified 22 mer | | UAUAAUUCAACUCAGGAAAUGG | 18 |
| GalXC-STAT3-1394 | Modified 36 mer | | [mAs][mU][mU][mU][mC][mC][mU][fG][fA][fG][fU][mU][mG][mA][mA][mU][mU][mA][mU][mA][mG][mC][mA][mG][mC][mC][mG][ademA-GalNAc][ademA-GalNAc][ademA-GalNAc][mG][mG][mC][mU][mG][mC] | 19 |
| GalXC-STAT3-1394 | Modified 22 mer | | [MePhosphonate-4O-mUs][fAs][fU][fA][fA][mU][fU][mC][mA][fA][mC][mU][mC][fA][mG][mG][mA][mA][mA][mUs][mGs][mG] | 20 |
| GalXC-STAT3-1398 | UnModified 36 mer | | CCUGAGUUGAAUUAUCAGCAGCAGCCGAAAGGCUGC | 21 |
| GalXC-STAT3-1398 | UnModified 22 mer | | UGCUGAUAAUUCAACUCAGGGG | 22 |
| GalXC-STAT3-1398 | Modified 36 mer | | [mCs][mC][mU][mG][mA][mG][mU][fU][fG][fA][fA][mU][mU][mA][mU][mC][mA][mG][mC][mA][mG][mC][mA][mG][mC][mC][mG][ademA-GalNAc][ademA-GalNAc][ademA-GalNAc][mG][mG][mC][mU][mG][mC] | 23 |
| GalXC-STAT3-1398 | Modified 22 mer | | [MePhosphonate-4O-mUs][fGs][fC][fU][fG][mA][fU][mA][mA][fU][mU][mC][mA][fA][mC][mU][mC][mA][mG][mGs][mGs][mG] | 24 |
| GalXC-STAT3-1399 | UnModified 36 mer | | CUGAGUUGAAUUAUCAGCUAGCAGCCGAAAGGCUGC | 25 |
| GalXC-STAT3-1399 | UnModified 22 mer | | UAGCUGAUAAUUCAACUCAGGG | 26 |
| GalXC-STAT3-1399 | Modified 36 mer | | [mCs][mU][mG][mA][mG][mU][mU][fG][fA][fA][fU][mU][mA][mU][mC][mA][mG][mC][mU][mA][mG][mC][mA][mG][mC][mC][mG][ademA-GalNAc][ademA-GalNAc][ademA-GalNAc][mG][mG][mC][mU][mG][mC] | 27 |
| GalXC-STAT3-1399 | Modified 22 mer | | [MePhosphonate-4O-mUs][fAs][fG][fC][fU][mG][fA][mU][mA][fA][mU][mU][mC][fA][mA][mC][mU][mC][mA][mGs][mGs][mG] | 28 |
| GalXC-STAT3-1400 | UnModified 36 mer | | UGAGUUGAAUUAUCAGCUUAGCAGCCGAAAGGCUGC | 29 |
| GalXC-STAT3-1400 | UnModified 22 mer | | UAAGCUGAUAAUUCAACUCAGG | 30 |
| GalXC-STAT3-1400 | Modified 36 mer | | [mUs][mG][mA][mG][mU][mU][mG][fA][fA][fU][fU][mA][mU][mC][mA][mG][mC][mU][mU][mA][mG][mC][mA][mG][mC][mC][mG][ademA-GalNAc][ademA-GalNAc][ademA-GalNAc][mG][mG][mC][mU][mG][mC] | 31 |
| GalXC-STAT3-1400 | Modified 22 mer | | [MePhosphonate-4O-mUs][fAs][fA][fG][fC][mU][fG][mA][mU][fA][mA][mU][mU][fC][mA][mA][mC][mU][mC][mAs][mGs][mG] | 32 |
| GalXC-STAT3-1401 | UnModified 36 mer | | GAGUUGAAUUAUCAGCUUAAGCAGCCGAAAGGCUGC | 33 |
| GalXC-STAT3-1401 | UnModified 22 mer | | UUAAGCUGAUAAUUCAACUCGG | 34 |

-continued

SEQUENCE LISTING

| Name | Description | Species | Sequence | SEQ ID NO |
|---|---|---|---|---|
| GalXC-STAT3-1401 | Modified 36 mer | | [mGs][mA][mG][mU][mU][mG][mA][fA][fU][fU][fA][mU][mC][mA][mG][mC][mU][mU][mA][mA][mG][mC][mA][mG][mC][mC][mG][ademA-GalNAc][ademA-GalNAc][ademA-GalNAc][mG][mG][mC][mU][mG][mC] | 35 |
| GalXC-STAT3-1401 | Modified 22 mer | | [MePhosphonate-4O-mUs][fUs][fA][fA][fG][mC][fU][mG][mA][fU][mA][mA][mU][fU][mC][mA][mA][mC][mU][mCs][mGs][mG] | 36 |
| GalXC-STAT3-1402 | UnModified 36 mer | | AGUUGAAUUAUCAGCUUAAAGCAGCCGAAAGGCUGC | 37 |
| GalXC-STAT3-1402 | UnModified 22 mer | | UUUAAGCUGAUAAUUCAACUGG | 38 |
| GalXC-STAT3-1402 | Modified 36 mer | | [mAs][mG][mU][mU][mG][mA][mA][fU][fU][fA][fU][mC][mA][mG][mC][mU][mU][mA][mA][mA][mG][mC][mA][mG][mC][mC][mG][ademA-GalNAc][ademA-GalNAc][ademA-GalNAc][mG][mG][mC][mU][mG][mC] | 39 |
| GalXC-STAT3-1402 | Modified 22 mer | | [MePhosphonate-4O-mUs][fUs][fU][fA][fA][mG][fC][mU][mG][fA][mU][mA][mA][fU][mU][mC][mA][mA][mC][mUs][mGs][mG] | 40 |
| GalXC-STAT3-1759 | UnModified 36 mer | | CAAUCCUGUGGUAUAACAUAGCAGCCGAAAGGCUGC | 41 |
| GalXC-STAT3-1759 | UnModified 22 mer | | UAUGUUAUACCACAGGAUUGGG | 42 |
| GalXC-STAT3-1759 | Modified 36 mer | | [mCs][mA][mA][mU][mC][mC][mU][fG][fU][fG][fG][mU][mA][mU][mA][mA][mC][mA][mU][mA][mG][mC][mA][mG][mC][mC][mG][ademA-GalNAc][ademA-GalNAc][ademA-GalNAc][mG][mG][mC][mU][mG][mC] | 43 |
| GalXC-STAT3-1759 | Modified 22 mer | | [MePhosphonate-4O-mUs][fAs][fU][fG][fU][mU][fA][mU][mA][fC][mC][mA][mC][fA][mG][mG][mA][mU][mU][mGs][mGs][mG] | 44 |
| GalXC-STAT3-2029 | UnModified 36 mer | | ACAAUAUCAUCGACCUUGUAGCAGCCGAAAGGCUGC | 45 |
| GalXC-STAT3-2029 | UnModified 22 mer | | UACAAGGUCGAUGAUAUUGUGG | 46 |
| GalXC-STAT3-2029 | Modified 36 mer | | [mAs][mC][mA][mA][mU][mA][mU][fC][fA][fU][fC][mG][mA][mC][mC][mU][mU][mG][mU][mA][mG][mC][mA][mG][mC][mC][mG][ademA-GalNAc][ademA-GalNAc][ademA-GalNAc][mG][mG][mC][mU][mG][mC] | 47 |
| GalXC-STAT3-2029 | Modified 22 mer | | [MePhosphonate-4O-mUs][fAs][fC][fA][fA][mG][fG][mU][mC][fG][mA][mU][mG][fA][mU][mA][mU][mU][mG][mUs][mGs][mG] | 48 |
| GalXC-STAT3-2034 | UnModified 36 mer | | AUCAUCGACCUUGUGAAAAAGCAGCCGAAAGGCUGC | 49 |
| GalXC-STAT3-2034 | UnModified 22 mer | | UUUUUCACAAGGUCGAUGAUGG | 50 |
| GalXC-STAT3-2034 | Modified 36 mer | | [mAs][mU][mC][mA][mU][mC][mG][fA][fC][fC][fU][mU][mG][mU][mG][mA][mA][mA][mA][mA][mG][mC][mA][mG][mC][mC][mG][ademA-GalNAc][ademA-GalNAc][ademA-GalNAc][mG][mG][mC][mU][mG][mC] | 51 |
| GalXC-STAT3-2034 | Modified 22 mer | | [MePhosphonate-4O-mUs][fUs][fU][fU][fU][mC][fA][mC][mA][fA][mG][mG][mU][fC][mG][mA][mU][mG][mA][mUs][mGs][mG] | 52 |
| GalXC-STAT3-2448 | UnModified 36 mer | | CUGAAGACCAAGUUCAUCUAGCAGCCGAAAGGCUGC | 53 |
| GalXC-STAT3-2448 | UnModified 22 mer | | UAGAUGAACUUGGUCUUCAGGG | 54 |
| GalXC-STAT3-2448 | Modified 36 mer | | [mCs][mU][mG][mA][mA][mG][mA][fC][fC][fA][fA][mG][mU][mU][mC][mA][mU][mC][mU][mA | 55 |

-continued

SEQUENCE LISTING

| Name | Description | Species | Sequence | SEQ ID NO |
|---|---|---|---|---|
| | | | ][mG][mC][mA][mG][mC][mC][mG][ademA-GalNAc][ademA-GalNAc][ademA-GalNAc][mG][mG][mC][mU][mG][mC] | |
| GalXC-STAT3-2448 | Modified 22 mer | | [MePhosphonate-4O-mUs][fAs][fG][fA][fU][mG][fA][mA][mC][fU][mU][mG][mG][fU][mC][mU][mU][mC][mA][mGs][mGs][mG] | 56 |
| GalXC-STAT3-2527 | UnModified 36 mer | | AUUCAUUGAUGCAGUUUGGAGCAGCCGAAAGGCUGC | 57 |
| GalXC-STAT3-2527 | UnModified 22 mer | | UCCAAACUGCAUCAAUGAAUGG | 58 |
| GalXC-STAT3-2527 | Modified 36 mer | | [mAs][mU][mU][mC][mA][mU][mU][fG][fA][fU][fG][mC][mA][mG][mU][mU][mU][mG][mG][mA][mG][mC][mA][mG][mC][mC][mG][ademA-GalNAc][ademA-GalNAc][ademA-GalNAc][mG][mG][mC][mU][mG][mC] | 59 |
| GalXC-STAT3-2527 | Modified 22 mer | | [MePhosphonate-4O-mUs][fCs][fC][fA][fA][mA][fC][mU][mG][fC][mA][mU][mC][fA][mA][mU][mG][mA][mA][mUs][mGs][mG] | 60 |
| GalXC-STAT3-4107 | UnModified 36 mer | | CCCAUCAAUGUUCUUUAGUAGCAGCCGAAAGGCUGC | 61 |
| GalXC-STAT3-4107 | UnModified 22 mer | | UACUAAAGAACAUUGAUGGGGG | 62 |
| GalXC-STAT3-4107 | Modified 36 mer | | [mCs][mC][mC][mA][mU][mC][mA][fA][fU][fG][fU][mU][mC][mU][mU][mU][mA][mG][mU][mA][mG][mC][mA][mG][mC][mC][mG][ademA-GalNAc][ademA-GalNAc][ademA-GalNAc] [mG][mG][mC][mU][mG][mC] | 63 |
| GalXC-STAT3-4107 | Modified 22 mer | | [MePhosphonate-4O-mUs][fAs][fC][fU][fA][mA][fA][mG][mA][fA][mC][mA][mU][fU][mG][mA][mU][mG][mG][mGs][mGs][mG] | 64 |
| GalXC-STAT3-4110 | UnModified 36 mer | | AUCAAUGUUCUUUAGUUAUAGCAGCCGAAAGGCUGC | 65 |
| GalXC-STAT3-4110 | UnModified 22 mer | | UAUAACUAAAGAACAUUGAUGG | 66 |
| GalXC-STAT3-4110 | Modified 36 mer | | [mAs][mU][mC][mA][mA][mU][mG][fU][fC][fU][mU][mU][mA][mG][mU][mU][mA][mU][mA][mG][mC][mA][mG][mC][mC][mG][ademA-GalNAc][ademA-GalNAc][ademA-GalNAc][mG][mG][mC][mU][mG][mC] | 67 |
| GalXC-STAT3-4110 | Modified 22 mer | | [MePhosphonate-4O-mUs][fAs][fU][fA][fA][mC][fU][mA][mA][fA][mG][mA][mA][fC][mA][mU][mU][mG][mA][mUs][mGs][mG] | 68 |
| GalXC-STAT3-4123 | UnModified 36 mer | | AGUUAUACAAUAAGCUGAAAGCAGCCGAAAGGCUGC | 69 |
| GalXC-STAT3-4123 | UnModified 22 mer | | UUUCAGCUUAUUGUAUAACUGG | 70 |
| GalXC-STAT3-4123 | Modified 36 mer | | [mAs][mG][mU][mU][mA][mU][mA][fC][fA][fA][fU][mA][mA][mG][mC][mU][mG][mA][mA][mA][mG][mC][mA][mG][mC][mC][mG][ademA-GalNAc][ademA-GalNAc][ademA-GalNAc][mG][mG][mC][mU][mG][mC] | 71 |
| GalXC-STAT3-4123 | Modified 22 mer | | [MePhosphonate-4O-mUs][fUs][fU][fC][fA][mG][fC][mU][mU][fA][mU][mU][mG][fU][mA][mU][mA][mA][mC][mUs][mGs][mG] | 72 |
| GalXC-STAT3-4435 | UnModified 36 mer | | AGUGUAAAAAUUUAUAUUAAGCAGCCGAAAGGCUGC | 73 |
| GalXC-STAT3-4435 | UnModified 22 mer | | UUAAUAUAAAUUUUUACACUGG | 74 |
| GalXC-STAT3-4435 | Modified 36 mer | | [mAs][mG][mU][mG][mU][mA][mA][fA][fA][fA][fU][mU][mU][mA][mU][mA][mU][mU][mA][mA][mG][mC][mA][mG][mC][mC][mG][ademA-GalNAc][ademA-GalNAc][ademA-GalNAc][mG][mG][mC][mU][mG][mC] | 75 |

-continued

SEQUENCE LISTING

| Name | Description | Species | Sequence | SEQ ID NO |
|---|---|---|---|---|
| GalXC-STAT3-4435 | Modified 22 mer | | [MePhosphonate-4O-mUs][fUs][fA][fA][fU][mA][fU][mA][mA][fA][mU][mU][mU][fU][mU][mA][mC][mA][mC][mUs][mGs][mG] | 76 |
| GalXC-STAT3-4474 | UnModified 36 mer | | UUGUUUGUUUUUGUAUAUUAGCAGCCGAAAGGCUGC | 77 |
| GalXC-STAT3-4474 | UnModified 22 mer | | UUAAUAUAAAUUUUUACACUGG | 78 |
| GalXC-STAT3-4474 | Modified 36 mer | | [mUs][mU][mG][mU][mU][mU][mG][fU][fU][fU][fU][mU][mG][mU][mA][mU][mA][mU][mU][mA][mG][mC][mA][mG][mC][mC][mG][ademA-GalNAc][ademA-GalNAc][ademA-GalNAc][mG][mG][mC][mU][mG][mC] | 79 |
| GalXC-STAT3-4474 | Modified 22 mer | | [MePhosphonate-4O-mUs][fAs][fA][fU][fA][mU][fA][mC][mA][fA][mA][mA][mA][fC][mA][mA][mA][mC][mA][mAs][mGs][mG] | 80 |
| GalXC-STAT3-4110-C18 | Modified 36 mer | | [mAs][mU][mC][mA][mA][mU][mG][fU][fU][fC][fU][mU][mU][mA][mG][mU][mU][mA][mU][mA][mG][mC][mA][mG][mC][mC][mG][ademA-C18][mA][mA][mG][mG][mC][mU][mG][mC] | 81 |
| GalXC-STAT3-4110-C18 | Modified 22 mer | | [MePhosphonate-4O-mUs][fAs][fU][fA][fA][mC][fU][mA][mA][fA][mG][mA][mA][fC][mA][mU][mU][mG][mA][mUs][mGs][mG] | 82 |
| GalXC-STAT3-4123-C18 | Modified 36 mer | | [mAs][mG][mU][mU][mA][mU][mA][fC][fA][fA][fU][mA][mA][mG][mC][mU][mG][mA][mA][mA][mG][mC][mA][mG][mC][mC][mG][ademA-C18][mA][mA][mG][mG][mC][mU][mG][mC] | 83 |
| GalXC-STAT3-4123-C18 | Modified 22 mer | | [MePhosphonate-4O-mUs][fUs][fU][fC][fA][mG][fC][mU][mU][fA][mU][mU][mG][fU][mA][mU][mA][mA][mC][mUs][mGs][mG] | 84 |
| | STAT3 Human (Hs) NM_001369512.1 (Genbank RefSeq #) | | GTCGCAGCCGAGGGAACAAGCCCCAACCGGATCCTGGACA GGCACCCCGGCTTGGCGCTGTCTCTCCCCCTCGGCTCGGA GAGGCCCTTCGGCCTGAGGGAGCCTCGCCGCCCGTCCCCG GCACACGCGCAGCCCCGGCCTCTCGGCCTCTGCCGGAGAA ACAGGATGGCCCAATGGAATCAGCTACAGCAGCTTGACAC ACGGTACCTGGAGCAGCTCCATCAGCTCTACAGTGACAGC TTCCCAATGGAGCTGCGGCAGTTTCTGGCCCCTTGGATTG AGAGTCAAGATTGGGCATATGCGGCCAGCAAAGAATCACA TGCCACTTTGGTGTTTCATAATCTCCTGGGAGAGATTGAC CAGCAGTATAGCCGCTTCCTGCAAGAGTCGAATGTTCTCT ATCAGCACAATCTACGAAGAATCAAGCAGTTTCTTCAGAG CAGGTATCTTGAGAAGCCAATGGAGATTGCCCGGATTGTG GCCCGGTGCCTGTGGGAAGAATCACGCCTTCTACAGACTG CAGCCACTGCGGCCCAGCAAGGGGGCCAGGCCAACCACCC CACAGCAGCCGTGGTGACGGAGAAGCAGCAGATGCTGGAG CAGCACCTTCAGGATGTCCGGAAGAGAGTGCAGGATCTAG AACAGAAAATGAAAGTGGTAGAGAATCTCCAGGATGACTT TGATTTCAACTATAAAACCCTCAAGAGTCAAGGAGACATG CAAGATCTGAATGGAAACAACCAGTCAGTGACCAGGCAGA AGATGCAGCAGCTGGAACAGATGCTCACTGCGCTGGACCA GATGCGGAGAAGCATCGTGAGTGAGCTGGCGGGGCTTTTG TCAGCGATGGAGTACGTGCAGAAAACTCTCACGGACGAGG AGCTGGCTGACTGGAAGAGGCGGCAACAGATTGCCTGCAT TGGAGGCCCGCCCAACATCTGCCTAGATCGGCTAGAAAAC TGGATAACGTCATTAGCAGAATCTCAACTTCAGACCCGTC AACAAATTAAGAAACTGGAGGAGTTGCAGCAAAAAGTTTC CTACAAAGGGGACCCCATTGTACAGCACCGGCCGATGCTG GAGGAGAGAATCGTGGAGCTGTTTAGAAACTTAATGAAAA GTGCCTTTGTGGTGGAGCGGCAGCCCTGCATGCCCATGCA TCCTGACCGGCCCCTCGTCATCAAGACCGGCGTCCAGTTC ACTACTAAAGTCAGGTTGCTGGTCAAATTCCCTGAGTTGA ATTATCAGCTTAAAATTAAAGTGTGCATTGACAAAGACTC TGGGGACGTTGCAGCTCTCAGAGGATCCCGGAAATTTAAC ATTCTGGGCACAAACACAAAAGTGATGAACATGGAAGAAT CCAACAACGGCAGCCTCTCTGCAGAATTCAAACACTTGAC CCTGAGGGAGCAGAGATGTGGGAATGGGGGCCGAGCCAAT | 85 |

-continued

SEQUENCE LISTING

| Name | Description | Species | Sequence | SEQ ID NO |
|---|---|---|---|---|
| | | | TGTGATGCTTCCCTGATTGTGACTGAGGAGCTGCACCTGA<br>TCACCTTTGAGACCGAGGTGTATCACCAAGGCCTCAAGAT<br>TGACCTAGAGACCCACTCCTTGCCAGTTGTGGTGATCTCC<br>AACATCTGTCAGATGCCAAATGCCTGGGCGTCCATCCTGT<br>GGTACAACATGCTGACCAACAATCCCAAGAATGTAAACTT<br>TTTTACCAAGCCCCCAATTGGAACCTGGGATCAAGTGGCC<br>GAGGTCCTGAGCTGGCAGTTCTCCTCCACCACCAAGCGAG<br>GACTGAGCATCGAGCAGCTGACTACACTGGCAGAGAAACT<br>CTTGGGACCTGGTGTGAATTATTCAGGGTGTCAGATCACA<br>TGGGCTAAATTTTGCAAAGAAAACATGGCTGGCAAGGGCT<br>TCTCCTTCTGGGTCTGGCTGGACAATATCATTGACCTTGT<br>GAAAAAGTACATCCTGGCCCTTTGGAACGAAGGGTACATC<br>ATGGGCTTTATCAGTAAGGAGCGGGAGCGGGCCATCTTGA<br>GCACTAAGCCTCCAGGCACCTTCCTGCTAAGATTCAGTGA<br>AAGCAGCAAAGAAGGAGGCGTCACTTTCACTTGGGTGGAG<br>AAGGACATCAGCGGTAAGACCCAGATCCAGTCCGTGGAAC<br>CATACACAAAGCAGCAGCTGAACAACATGTCATTTGCTGA<br>AATCATCATGGGCTATAAGATCATGGATGCTACCAATATC<br>CTGGTGTCTCCACTGGTCTATCTCTATCCTGACATTCCCA<br>AGGAGGAGGCATTCGGAAAGTATTGTCGGCCAGAGAGCCA<br>GGAGCATCCTGAAGCTGACCCAGGTAGCGCTGCCCCATAC<br>CTGAAGACCAAGTTTATCTGTGTGACACCAACGACCTGCA<br>GCAATACCATTGACCTGCCGATGTCCCCCCGCACTTTAGA<br>TTCATTGATGCAGTTTGGAAATAATGGTGAAGGTGCTGAA<br>CCCTCAGCAGGAGGGCAGTTTGAGTCCCTCACCTTTGACA<br>TGGAGTTGACCTCGGAGTGCGCTACCTCCCCCATGTGAGG<br>AGCTGAGAACGGAAGCTGCAGAAAGATACGACTGAGGCGC<br>CTACCTGCATTCTGCCACCCCTCACACAGCCAAACCCCAG<br>ATCATCTGAAACTACTAACTTTGTGGTTCCAGATTTTTTT<br>TAATCTCCTACTTCTGCTATCTTTGAGCAATCTGGGCACT<br>TTTAAAAATAGAGAAATGAGTGAATGTGGGTGATCTGCTT<br>TTATCTAAATGCAAATAAGGATGTGTTCTCTGAGACCCAT<br>GATCAGGGGATGTGGCGGGGGGTGGCTAGAGGGAGAAAAA<br>GGAAATGTCTTGTGTTGTTTTGTTCCCCTGCCCTCCTTTC<br>TCAGCAGCTTTTTGTTATTGTTGTTGTTGTTCTTAGACAA<br>GTGCCTCCTGGTGCCTGCGGCATCCTTCTGCCTGTTTCTG<br>TAAGCAAATGCCACAGGCCACCTATAGCTACATACTCCTG<br>GCATTGCACTTTTTAACCTTGCTGACATCCAAATAGAAGA<br>TAGGACTATCTAAGCCCTAGGTTTCTTTTTAAATTAAGAA<br>ATAATAACAATTAAAGGGCAAAAAACACTGTATCAGCATA<br>GCCTTTCTGTATTTAAGAAACTTAAGCAGCCGGGCATGGT<br>GGCTCACGCCTGTAATCCCAGCACTTTGGGAGGCCGAGGC<br>GGATCATAAGGTCAGGAGATCAAGACCATCCTGGCTAACA<br>CGGTGAAACCCCGTCTCTACTAAAAGTACAAAAAATTAGC<br>TGGGTGTGGTGGTGGGCGCCTGTAGTCCCAGCTACTCGGG<br>AGGCTGAGGCAGGAGAATCGCTTGAACCTGAGAGGCGGAG<br>GTTGCAGTGAGCCAAAATTGCACCACTGCACACTGCACTC<br>CATCCTGGGCGACAGTCTGAGACTCTGTCTCAAAAAAAAA<br>AAAAAAAAAAGAAACTTCAGTTAACAGCCTCCTTGGTGC<br>TTTAAGCATTCAGCTTCCTTCAGGCTGGTAATTTATATAA<br>TCCCTGAAACGGGCTTCAGGTCAAACCCTTAAGACATCTG<br>AAGCTGCAACCTGGCCTTTGGTGTTGAAATAGGAAGGTTT<br>AAGGAGAATCTAAGCATTTTAGACTTTTTTTTATAAATAG<br>ACTTATTTTCCTTTGTAATGTATTGGCCTTTTAGTGAGTA<br>AGGCTGGGCAGAGGGTGCTTACAACCTTGACTCCCTTTCT<br>CCCTGGACTTGATCTGCTGTTTCAGAGGCTAGGTTGTTTC<br>TGTGGGTGCCTTATCAGGGCTGGGATACTTCTGATTCTGG<br>CTTCCTTCCTGCCCCACCCTCCCGACCCCAGTCCCCCTGA<br>TCCTGCTAGAGGCATGTCTCCTTGCGTGTCTAAAGGTCCC<br>TCATCCTGTTTGTTTTAGGAATCCTGGTCTCAGGACCTCA<br>TGGAAGAAGAGGGGGAGAGAGTTACAGGTTGGACATGATG<br>CACACTATGGGGCCCCAGCGACGTGTCTGGTTGAGCTCAG<br>GGAATATGGTTCTTAGCCAGTTTCTTGGTGATATCCAGTG<br>GCACTTGTAATGGCGTCTTCATTCAGTTCATGCAGGGCAA<br>AGGCTTACTGATAAACTTGAGTCTGCCCTCGTATGAGGGT<br>GTATACCTGGCCTCCCTCTGAGGCTGGTGACTCCTCCCTG<br>CTGGGGCCCCACAGGTGAGGCAGAACAGCTAGAGGGCCTC<br>CCCGCCTGCCCGCCTTGGCTGGCTAGCTCGCCTCTCCTGT<br>GCGTATGGGAACACCTAGCACGTGCTGGATGGGCTGCCTC<br>TGACTCAGAGGCATGGCCGGATTTGGCAACTCAAAACCAC<br>CTTGCCTCAGCTGATCAGAGTTTCTGTGGAATTCTGTTTG<br>TTAAATCAAATTAGCTGGTCTCTGAATTAAGGGGGAGACG<br>ACCTTCTCTAAGATGAACAGGGTTCGCCCCAGTCCTCCTG | |

-continued

SEQUENCE LISTING

| Name | Description | Species | Sequence | SEQ ID NO |
|---|---|---|---|---|
| | | | CCTGGAGACAGTTGATGTGTCATGCAGAGCTCTTACTTCT CCAGCAACACTCTTCAGTACATAATAAGCTTAACTGATAA ACAGAATATTTAGAAAGGTGAGACTTGGGCTTACCATTGG GTTTAAATCATAGGGACCTAGGGCGAGGGTTCAGGGCTTC TCTGGAGCAGATATTGTCAAGTTCATGGCCTTAGGTAGCA TGTATCTGGTCTTAACTCTGATTGTAGCAAAAGTTCTGAG AGGAGCTGAGCCCTGTTGTGGCCCATTAAAGAACAGGGTC CTCAGGCCCTGCCCGCTTCCTGTCCACTGCCCCCTCCCCA TCCCCAGCCCAGCCGAGGGAATCCCGTGGGTTGCTTACCT ACCTATAAGGTGGTTTATAAGCTGCTGTCCTGGCCACTGC ATTCAAATTCCAATGTGTACTTCATAGTGTAAAAATTTAT ATTATTGTGAGGTTTTTTGTCTTTTTTTTTTTTTTTTTTT TTTGGTATATTGCTGTATCTACTTTAACTTCCAGAAATAA ACGTTATATAGGAACCGTC | |
| | Stem Loop | | GCAGCCGAAAGGCUGC | 86 |
| GalXC-STAT3-2029 | Modified 36 mer | | [mAs][mU][mC][mA][mA][mU][mG][fU][fU][fC ][fU][mU][mU][mA][mG][mU][mU][mA][mU][mA ][mG][mC][mA][mG][mC][mC][mG][ademA-C18] [mA][mA][mG][mG][mC][mU][mG][mC] | 87 |
| STAT3-4123-C18 | Modified 36 mer | | [mAs][mG][mU][mU][mA][mU][mA][fC][fA][fA ][fU][mA][mA][mG][mC][mU][mG][mA][mA][mA ][mG][mC][mA][mG][mC][mC][mG][ademA-C18] [mA][mA][mG][mG][mC][mU][mG][mC] | 88 |
| STAT3-370 | Sense 19 mer | | CACUUUGGUGUUUCAUAAU | 89 |
| STAT3-372 | Sense 19 mer | | CUUUGGUGUUUCAUAAUCU | 90 |
| STAT3-424 | Sense 19 mer | | CCUGCAAGAGUCGAAUGUU | 91 |
| STAT3-425 | Sense 19 mer | | CUGCAAGAGUCGAAUGUUC | 92 |
| STAT3-426 | Sense 19 mer | | UGCAAGAGUCGAAUGUUCU | 93 |
| STAT3-429 | Sense 19 mer | | AAGAGUCGAAUGUUCUCUA | 94 |
| STAT3-430 | Sense 19 mer | | AGAGUCGAAUGUUCUCUAU | 95 |
| STAT3-432 | Sense 19 mer | | AGUCGAAUGUUCUCUAUCA | 96 |
| STAT3-433 | Sense 19 mer | | GUCGAAUGUUCUCUAUCAG | 97 |
| STAT3-460 | Sense 19 mer | | ACGAAGAAUCAAGCAGUUU | 98 |
| STAT3-461 | Sense 19 mer | | CGAAGAAUCAAGCAGUUUC | 99 |
| STAT3-462 | Sense 19 mer | | GAAGAAUCAAGCAGUUUCU | 100 |
| STAT3-492 | Sense 19 mer | | AUCUUGAGAAGCCAAUGGA | 101 |
| STAT3-678 | Sense 19 mer | | AGGAUCUAGAACAGAAAAU | 102 |
| STAT3-681 | Sense 19 mer | | AUCUAGAACAGAAAAUGAA | 103 |
| STAT3-715 | Sense 19 mer | | CCAGGAUGACUUUGAUUUC | 104 |
| STAT3-716 | Sense 19 mer | | CAGGAUGACUUUGAUUUCA | 105 |
| STAT3-717 | Sense 19 mer | | AGGAUGACUUUGAUUUCAA | 106 |
| STAT3-720 | Sense 19 mer | | AUGACUUUGAUUUCAACUA | 107 |
| STAT3-721 | Sense 19 mer | | UGACUUUGAUUUCAACUAU | 108 |
| STAT3-722 | Sense 19 mer | | GACUUUGAUUUCAACUAUA | 109 |
| STAT3-723 | Sense 19 mer | | ACUUUGAUUUCAACUAUAA | 110 |
| STAT3-724 | Sense 19 mer | | CUUUGAUUUCAACUAUAAA | 111 |

-continued

SEQUENCE LISTING

| Name | Description | Species | Sequence | SEQ ID NO |
|---|---|---|---|---|
| STAT3-768 | Sense 19 mer | | AAGAUCUGAAUGGAAACAA | 112 |
| STAT3-771 | Sense 19 mer | | AUCUGAAUGGAAACAACCA | 113 |
| STAT3-773 | Sense 19 mer | | CUGAAUGGAAACAACCAGU | 114 |
| STAT3-1000 | Sense 19 mer | | AGAAAACUGGAUAACGUCA | 115 |
| STAT3-1001 | Sense 19 mer | | GAAAACUGGAUAACGUCAU | 116 |
| STAT3-1003 | Sense 19 mer | | AAACUGGAUAACGUCAUUA | 117 |
| STAT3-1006 | Sense 19 mer | | CUGGAUAACGUCAUUAGCA | 118 |
| STAT3-1008 | Sense 19 mer | | GGAUAACGUCAUUAGCAGA | 119 |
| STAT3-1009 | Sense 19 mer | | GAUAACGUCAUUAGCAGAA | 120 |
| STAT3-1010 | Sense 19 mer | | AUAACGUCAUUAGCAGAAU | 121 |
| STAT3-1047 | Sense 19 mer | | AACAAAUUAAGAAACUGGA | 122 |
| STAT3-1067 | Sense 19 mer | | GAGUUGCAGCAAAAAGUUU | 123 |
| STAT3-1068 | Sense 19 mer | | AGUUGCAGCAAAAAGUUUC | 124 |
| STAT3-1145 | Sense 19 mer | | CUGUUUAGAAACUUAAUGA | 125 |
| STAT3-1151 | Sense 19 mer | | AGAAACUUAAUGAAAAGUG | 126 |
| STAT3-1241 | Sense 19 mer | | CAGUUCACUACUAAAGUCA | 127 |
| STAT3-1268 | Sense 19 mer | | GUCAAAUUCCCUGAGUUGA | 128 |
| STAT3-1272 | Sense 19 mer | | AAUUCCCUGAGUUGAAUUA | 129 |
| STAT3-1273 | Sense 19 mer | | AUUCCCUGAGUUGAAUUAU | 130 |
| STAT3-1275 | Sense 19 mer | | UCCCUGAGUUGAAUUAUCA | 131 |
| STAT3-1277 | Sense 19 mer | | CCUGAGUUGAAUUAUCAGC | 132 |
| STAT3-1278 | Sense 19 mer | | CUGAGUUGAAUUAUCAGCU | 133 |
| STAT3-1279 | Sense 19 mer | | UGAGUUGAAUUAUCAGCUU | 134 |
| STAT3-1280 | Sense 19 mer | | GAGUUGAAUUAUCAGCUUA | 135 |
| STAT3-1281 | Sense 19 mer | | AGUUGAAUUAUCAGCUUAA | 136 |
| STAT3-1282 | Sense 19 mer | | GUUGAAUUAUCAGCUUAAA | 137 |
| STAT3-1283 | Sense 19 mer | | UUGAAUUAUCAGCUUAAAA | 138 |
| STAT3-1284 | Sense 19 mer | | UGAAUUAUCAGCUUAAAAU | 139 |
| STAT3-1286 | Sense 19 mer | | AAUUAUCAGCUUAAAAUUA | 140 |
| STAT3-1287 | Sense 19 mer | | AUUAUCAGCUUAAAAUUAA | 141 |
| STAT3-1292 | Sense 19 mer | | CAGCUUAAAAUUAAAGUGU | 142 |
| STAT3-1293 | Sense 19 mer | | AGCUUAAAAUUAAAGUGUG | 143 |
| STAT3-1299 | Sense 19 mer | | AAAUUAAAGUGUGCAUUGA | 144 |
| STAT3-1305 | Sense 19 mer | | AAGUGUGCAUUGACAAAGA | 145 |
| STAT3-1383 | Sense 19 mer | | CAAAAGUGAUGAACAUGGA | 146 |
| STAT3-1388 | Sense 19 mer | | GUGAUGAACAUGGAAGAAU | 147 |
| STAT3-1427 | Sense 19 mer | | GCAGAAUUCAAACACUUGA | 148 |

-continued

SEQUENCE LISTING

| Name | Description | Species | Sequence | SEQ ID NO |
|---|---|---|---|---|
| STAT3-1485 | Sense 19 mer | | AUUGUGAUGCUUCCCUGAU | 149 |
| STAT3-1584 | Sense 19 mer | | CCUUGCCAGUUGUGGUGAU | 150 |
| STAT3-1586 | Sense 19 mer | | UUGCCAGUUGUGGUGAUCU | 151 |
| STAT3-1670 | Sense 19 mer | | CCCAAGAAUGUAAACUUUU | 152 |
| STAT3-1671 | Sense 19 mer | | CCAAGAAUGUAAACUUUUU | 153 |
| STAT3-1672 | Sense 19 mer | | CAAGAAUGUAAACUUUUUU | 154 |
| STAT3-1673 | Sense 19 mer | | AAGAAUGUAAACUUUUUUA | 155 |
| STAT3-1674 | Sense 19 mer | | AGAAUGUAAACUUUUUUAC | 156 |
| STAT3-1676 | Sense 19 mer | | AAUGUAAACUUUUUUACCA | 157 |
| STAT3-1813 | Sense 19 mer | | ACCUGGUGUGAAUUAUUCA | 158 |
| STAT3-1815 | Sense 19 mer | | CUGGUGUGAAUUAUUCAGG | 159 |
| STAT3-1817 | Sense 19 mer | | GGUGUGAAUUAUUCAGGGU | 160 |
| STAT3-1819 | Sense 19 mer | | UGUGAAUUAUUCAGGGUGU | 161 |
| STAT3-1904 | Sense 19 mer | | CUGGACAAUAUCAUUGACC | 162 |
| STAT3-1906 | Sense 19 mer | | GGACAAUAUCAUUGACCUU | 163 |
| STAT3-1907 | Sense 19 mer | | GACAAUAUCAUUGACCUUG | 164 |
| STAT3-1908 | Sense 19 mer | | ACAAUAUCAUUGACCUUGU | 165 |
| STAT3-1909 | Sense 19 mer | | CAAUAUCAUUGACCUUGUG | 166 |
| STAT3-1910 | Sense 19 mer | | AAUAUCAUUGACCUUGUGA | 167 |
| STAT3-1911 | Sense 19 mer | | AUAUCAUUGACCUUGUGAA | 168 |
| STAT3-1912 | Sense 19 mer | | UAUCAUUGACCUUGUGAAA | 169 |
| STAT3-1913 | Sense 19 mer | | AUCAUUGACCUUGUGAAAA | 170 |
| STAT3-1914 | Sense 19 mer | | UCAUUGACCUUGUGAAAAA | 171 |
| STAT3-1916 | Sense 19 mer | | AUUGACCUUGUGAAAAAGU | 172 |
| STAT3-1917 | Sense 19 mer | | UUGACCUUGUGAAAAAGUA | 173 |
| STAT3-1919 | Sense 19 mer | | GACCUUGUGAAAAAGUACA | 174 |
| STAT3-1920 | Sense 19 mer | | ACCUUGUGAAAAAGUACAU | 175 |
| STAT3-2024 | Sense 19 mer | | ACCUUCCUGCUAAGAUUCA | 176 |
| STAT3-2135 | Sense 19 mer | | AAGCAGCAGCUGAACAACA | 177 |
| STAT3-2136 | Sense 19 mer | | AGCAGCAGCUGAACAACAU | 178 |
| STAT3-2138 | Sense 19 mer | | CAGCAGCUGAACAACAUGU | 179 |
| STAT3-2139 | Sense 19 mer | | AGCAGCUGAACAACAUGUC | 180 |
| STAT3-2143 | Sense 19 mer | | GCUGAACAACAUGUCAUUU | 181 |
| STAT3-2144 | Sense 19 mer | | CUGAACAACAUGUCAUUUG | 182 |
| STAT3-2145 | Sense 19 mer | | UGAACAACAUGUCAUUUGC | 183 |
| STAT3-2146 | Sense 19 mer | | GAACAACAUGUCAUUUGCU | 184 |

-continued

SEQUENCE LISTING

| Name | Description | Species | Sequence | SEQ ID NO |
|---|---|---|---|---|
| STAT3-2147 | Sense 19 mer | | AACAACAUGUCAUUUGCUG | 185 |
| STAT3-2148 | Sense 19 mer | | ACAACAUGUCAUUUGCUGA | 186 |
| STAT3-2151 | Sense 19 mer | | ACAUGUCAUUUGCUGAAAU | 187 |
| STAT3-2153 | Sense 19 mer | | AUGUCAUUUGCUGAAAUCA | 188 |
| STAT3-2154 | Sense 19 mer | | UGUCAUUUGCUGAAAUCAU | 189 |
| STAT3-2159 | Sense 19 mer | | UUUGCUGAAAUCAUCAUGG | 190 |
| STAT3-2322 | Sense 19 mer | | CAUACCUGAAGACCAAGUU | 191 |
| STAT3-2325 | Sense 19 mer | | ACCUGAAGACCAAGUUUAU | 192 |
| STAT3-2327 | Sense 19 mer | | CUGAAGACCAAGUUUAUCU | 193 |
| STAT3-2329 | Sense 19 mer | | GAAGACCAAGUUUAUCUGU | 194 |
| STAT3-2333 | Sense 19 mer | | ACCAAGUUUAUCUGUGUGA | 195 |
| STAT3-2335 | Sense 19 mer | | CAAGUUUAUCUGUGUGACA | 196 |
| STAT3-2404 | Sense 19 mer | | AGAUUCAUUGAUGCAGUUU | 197 |
| STAT3-2405 | Sense 19 mer | | GAUUCAUUGAUGCAGUUUG | 198 |
| STAT3-2407 | Sense 19 mer | | UUCAUUGAUGCAGUUUGGA | 199 |
| STAT3-2408 | Sense 19 mer | | UCAUUGAUGCAGUUUGGAA | 200 |
| STAT3-2411 | Sense 19 mer | | UUGAUGCAGUUUGGAAAUA | 201 |
| STAT3-2412 | Sense 19 mer | | UGAUGCAGUUUGGAAAUAA | 202 |
| STAT3-2413 | Sense 19 mer | | GAUGCAGUUUGGAAAUAAU | 203 |
| STAT3-2416 | Sense 19 mer | | GCAGUUUGGAAAUAAUGGU | 204 |
| STAT3-2418 | Sense 19 mer | | AGUUUGGAAAUAAUGGUGA | 205 |
| STAT3-2422 | Sense 19 mer | | UGGAAAUAAUGGUGAAGGU | 206 |
| STAT3-2427 | Sense 19 mer | | AUAAUGGUGAAGGUGCUGA | 207 |
| STAT3-2612 | Sense 19 mer | | CUGAAACUACUAACUUUGU | 208 |
| STAT3-2615 | Sense 19 mer | | AAACUACUAACUUUGUGGU | 209 |
| STAT3-2616 | Sense 19 mer | | AACUACUAACUUUGUGGUU | 210 |
| STAT3-2617 | Sense 19 mer | | ACUACUAACUUUGUGGUUC | 211 |
| STAT3-2622 | Sense 19 mer | | UAACUUUGUGGUUCCAGAU | 212 |
| STAT3-2625 | Sense 19 mer | | CUUUGUGGUUCCAGAUUUU | 213 |
| STAT3-2626 | Sense 19 mer | | UUUGUGGUUCCAGAUUUUU | 214 |
| STAT3-2627 | Sense 19 mer | | UUGUGGUUCCAGAUUUUUU | 215 |
| STAT3-2692 | Sense 19 mer | | AAAUAGAGAAAUGAGUGAA | 216 |
| STAT3-2693 | Sense 19 mer | | AAUAGAGAAAUGAGUGAAU | 217 |
| STAT3-2715 | Sense 19 mer | | GGUGAUCUGCUUUUAUCUA | 218 |
| STAT3-2719 | Sense 19 mer | | AUCUGCUUUUAUCUAAAUG | 219 |
| STAT3-2721 | Sense 19 mer | | CUGCUUUUAUCUAAAUGCA | 220 |
| STAT3-2735 | Sense 19 mer | | AUGCAAAUAAGGAUGUGUU | 221 |

-continued

SEQUENCE LISTING

| Name | Description | Species | Sequence | SEQ ID NO |
|---|---|---|---|---|
| STAT3-2741 | Sense 19 mer | | AUAAGGAUGUGUUCUCUGA | 222 |
| STAT3-2801 | Sense 19 mer | | GAAAAAGGAAAUGUCUUGU | 223 |
| STAT3-2803 | Sense 19 mer | | AAAAGGAAAUGUCUUGUGU | 224 |
| STAT3-2804 | Sense 19 mer | | AAAGGAAAUGUCUUGUGUU | 225 |
| STAT3-2806 | Sense 19 mer | | AGGAAAUGUCUUGUGUUGU | 226 |
| STAT3-2807 | Sense 19 mer | | GGAAAUGUCUUGUGUUGUU | 227 |
| STAT3-2808 | Sense 19 mer | | GAAAUGUCUUGUGUUGUUU | 228 |
| STAT3-2809 | Sense 19 mer | | AAAUGUCUUGUGUUGUUUU | 229 |
| STAT3-2810 | Sense 19 mer | | AAUGUCUUGUGUUGUUUUG | 230 |
| STAT3-2811 | Sense 19 mer | | AUGUCUUGUGUUGUUUUGU | 231 |
| STAT3-2812 | Sense 19 mer | | UGUCUUGUGUUGUUUUGUU | 232 |
| STAT3-2813 | Sense 19 mer | | GUCUUGUGUUGUUUUGUUC | 233 |
| STAT3-2846 | Sense 19 mer | | CUCAGCAGCUUUUUGUUAU | 234 |
| STAT3-2848 | Sense 19 mer | | CAGCAGCUUUUUGUUAUUG | 235 |
| STAT3-2849 | Sense 19 mer | | AGCAGCUUUUUGUUAUUGU | 236 |
| STAT3-2850 | Sense 19 mer | | GCAGCUUUUUGUUAUUGUU | 237 |
| STAT3-2851 | Sense 19 mer | | CAGCUUUUUGUUAUUGUUG | 238 |
| STAT3-2852 | Sense 19 mer | | AGCUUUUUGUUAUUGUUGU | 239 |
| STAT3-2853 | Sense 19 mer | | GCUUUUUGUUAUUGUUGUU | 240 |
| STAT3-2854 | Sense 19 mer | | CUUUUUGUUAUUGUUGUUG | 241 |
| STAT3-2855 | Sense 19 mer | | UUUUUGUUAUUGUUGUUGU | 242 |
| STAT3-2856 | Sense 19 mer | | UUUUGUUAUUGUUGUUGUU | 243 |
| STAT3-2857 | Sense 19 mer | | UUUGUUAUUGUUGUUGUUG | 244 |
| STAT3-2858 | Sense 19 mer | | UUGUUAUUGUUGUUGUUGU | 245 |
| STAT3-2859 | Sense 19 mer | | UGUUAUUGUUGUUGUUGUU | 246 |
| STAT3-2860 | Sense 19 mer | | GUUAUUGUUGUUGUUGUUC | 247 |
| STAT3-2861 | Sense 19 mer | | UUAUUGUUGUUGUUGUUCU | 248 |
| STAT3-2862 | Sense 19 mer | | UAUUGUUGUUGUUGUUCUU | 249 |
| STAT3-2863 | Sense 19 mer | | AUUGUUGUUGUUGUUCUUA | 250 |
| STAT3-2865 | Sense 19 mer | | UGUUGUUGUUGUUCUUAGA | 251 |
| STAT3-2867 | Sense 19 mer | | UUGUUGUUGUUCUUAGACA | 252 |
| STAT3-2868 | Sense 19 mer | | UGUUGUUGUUCUUAGACAA | 253 |
| STAT3-2975 | Sense 19 mer | | CUUUUUAACCUUGCUGACA | 254 |
| STAT3-2979 | Sense 19 mer | | UUAACCUUGCUGACAUCCA | 255 |
| STAT3-2985 | Sense 19 mer | | UUGCUGACAUCCAAAUAGA | 256 |
| STAT3-3025 | Sense 19 mer | | AGGUUUCUUUUUAAAUUAA | 257 |

-continued

SEQUENCE LISTING

| Name | Description | Species | Sequence | SEQ ID NO |
|---|---|---|---|---|
| STAT3-3037 | Sense 19 mer | | AAAUUAAGAAAUAAUAACA | 258 |
| STAT3-3038 | Sense 19 mer | | AAUUAAGAAAUAAUAACAA | 259 |
| STAT3-3039 | Sense 19 mer | | AUUAAGAAAUAAUAACAAU | 260 |
| STAT3-3041 | Sense 19 mer | | UAAGAAAUAAUAACAAUUA | 261 |
| STAT3-3042 | Sense 19 mer | | AAGAAAUAAUAACAAUUAA | 262 |
| STAT3-3043 | Sense 19 mer | | AGAAAUAAUAACAAUUAAA | 263 |
| STAT3-3225 | Sense 19 mer | | ACUAAAAGUACAAAAAAUU | 264 |
| STAT3-3226 | Sense 19 mer | | CUAAAAGUACAAAAAAUUA | 265 |
| STAT3-3605 | Sense 19 mer | | AGACUUAUUUUCCUUUGUA | 266 |
| STAT3-3611 | Sense 19 mer | | AUUUUCCUUUGUAAUGUAU | 267 |
| STAT3-3906 | Sense 19 mer | | AGUUACAGGUUGGACAUGA | 268 |
| STAT3-4311 | Sense 19 mer | | UGUGGAAUUCUGUUUGUUA | 269 |
| STAT3-4314 | Sense 19 mer | | GGAAUUCUGUUUGUUAAAU | 270 |
| STAT3-4317 | Sense 19 mer | | AUUCUGUUUGUUAAAUCAA | 271 |
| STAT3-4321 | Sense 19 mer | | UGUUUGUUAAAUCAAAUUA | 272 |
| STAT3-4465 | Sense 19 mer | | ACAUAAUAAGCUUAACUGA | 273 |
| STAT3-4479 | Sense 19 mer | | ACUGAUAAACAGAAUAUUU | 274 |
| STAT3-4480 | Sense 19 mer | | CUGAUAAACAGAAUAUUUA | 275 |
| STAT3-4831 | Sense 19 mer | | UAGUGUAAAAAUUUAUAUU | 276 |
| STAT3-4833 | Sense 19 mer | | GUGUAAAAAUUUAUAUUAU | 277 |
| STAT3-4836 | Sense 19 mer | | UAAAAAUUUAUAUUAUUGU | 278 |
| STAT3-4837 | Sense 19 mer | | AAAAAUUUAUAUUAUUGUG | 279 |
| STAT3-4909 | Sense 19 mer | | UUUAACUUCCAGAAAUAAA | 280 |
| STAT3-370 | AntiSense 19 mer | | AUUAUGAAACACCAAAGUG | 281 |
| STAT3-372 | AntiSense 19 mer | | AGAUUAUGAAACACCAAAG | 282 |
| STAT3-424 | AntiSense 19 mer | | AACAUUCGACUCUUGCAGG | 283 |
| STAT3-425 | AntiSense 19 mer | | GAACAUUCGACUCUUGCAG | 284 |
| STAT3-426 | AntiSense 19 mer | | AGAACAUUCGACUCUUGCA | 285 |
| STAT3-429 | AntiSense 19 mer | | UAGAGAACAUUCGACUCUU | 286 |
| STAT3-430 | AntiSense 19 mer | | AUAGAGAACAUUCGACUCU | 287 |
| STAT3-432 | AntiSense 19 mer | | UGAUAGAGAACAUUCGACU | 288 |
| STAT3-433 | AntiSense 19 mer | | CUGAUAGAGAACAUUCGAC | 289 |
| STAT3-460 | AntiSense 19 mer | | AAACUGCUUGAUUCUUCGU | 290 |
| STAT3-461 | AntiSense 19 mer | | GAAACUGCUUGAUUCUUCG | 291 |
| STAT3-462 | AntiSense 19 mer | | AGAAACUGCUUGAUUCUUC | 292 |
| STAT3-492 | AntiSense 19 mer | | UCCAUUGGCUUCUCAAGAU | 293 |
| STAT3-678 | AntiSense 19 mer | | AUUUUCUGUUCUAGAUCCU | 294 |

-continued

SEQUENCE LISTING

| Name | Description | Species | Sequence | SEQ ID NO |
|---|---|---|---|---|
| STAT3-681 | AntiSense 19 mer | | UUCAUUUUCUGUUCUAGAU | 295 |
| STAT3-715 | AntiSense 19 mer | | GAAAUCAAAGUCAUCCUGG | 296 |
| STAT3-716 | AntiSense 19 mer | | UGAAAUCAAAGUCAUCCUG | 297 |
| STAT3-717 | AntiSense 19 mer | | UUGAAAUCAAAGUCAUCCU | 298 |
| STAT3-720 | AntiSense 19 mer | | UAGUUGAAAUCAAAGUCAU | 299 |
| STAT3-721 | AntiSense 19 mer | | AUAGUUGAAAUCAAAGUCA | 300 |
| STAT3-722 | AntiSense 19 mer | | UAUAGUUGAAAUCAAAGUC | 301 |
| STAT3-723 | AntiSense 19 mer | | UUAUAGUUGAAAUCAAAGU | 302 |
| STAT3-724 | AntiSense 19 mer | | UUUAUAGUUGAAAUCAAAG | 303 |
| STAT3-768 | AntiSense 19 mer | | UUGUUUCCAUUCAGAUCUU | 304 |
| STAT3-771 | AntiSense 19 mer | | UGGUUGUUUCCAUUCAGAU | 305 |
| STAT3-773 | AntiSense 19 mer | | ACUGGUUGUUUCCAUUCAG | 306 |
| STAT3-1000 | AntiSense 19 mer | | UGACGUUAUCCAGUUUUCU | 307 |
| STAT3-1001 | AntiSense 19 mer | | AUGACGUUAUCCAGUUUUC | 308 |
| STAT3-1003 | AntiSense 19 mer | | UAAUGACGUUAUCCAGUUU | 309 |
| STAT3-1006 | AntiSense 19 mer | | UGCUAAUGACGUUAUCCAG | 310 |
| STAT3-1008 | AntiSense 19 mer | | UCUGCUAAUGACGUUAUCC | 311 |
| STAT3-1009 | AntiSense 19 mer | | UUCUGCUAAUGACGUUAUC | 312 |
| STAT3-1010 | AntiSense 19 mer | | AUUCUGCUAAUGACGUUAU | 313 |
| STAT3-1047 | AntiSense 19 mer | | UCCAGUUUCUUAAUUUGUU | 314 |
| STAT3-1067 | AntiSense 19 mer | | AAACUUUUUGCUGCAACUC | 315 |
| STAT3-1068 | AntiSense 19 mer | | GAAACUUUUUGCUGCAACU | 316 |
| STAT3-1145 | AntiSense 19 mer | | UCAUUAAGUUUCUAAACAG | 317 |
| STAT3-1151 | AntiSense 19 mer | | CACUUUUCAUUAAGUUUCU | 318 |
| STAT3-1241 | AntiSense 19 mer | | UGACUUUAGUAGUGAACUG | 319 |
| STAT3-1268 | AntiSense 19 mer | | UCAACUCAGGGAAUUUGAC | 320 |
| STAT3-1272 | AntiSense 19 mer | | UAAUUCAACUCAGGGAAUU | 321 |
| STAT3-1273 | AntiSense 19 mer | | AUAAUUCAACUCAGGGAAU | 322 |
| STAT3-1275 | AntiSense 19 mer | | UGAUAAUUCAACUCAGGGA | 323 |
| STAT3-1277 | AntiSense 19 mer | | GCUGAUAAUUCAACUCAGG | 324 |
| STAT3-1278 | AntiSense 19 mer | | AGCUGAUAAUUCAACUCAG | 325 |
| STAT3-1279 | AntiSense 19 mer | | AAGCUGAUAAUUCAACUCA | 326 |
| STAT3-1280 | AntiSense 19 mer | | UAAGCUGAUAAUUCAACUC | 327 |
| STAT3-1281 | AntiSense 19 mer | | UUAAGCUGAUAAUUCAACU | 328 |
| STAT3-1282 | AntiSense 19 mer | | UUUAAGCUGAUAAUUCAAC | 329 |
| STAT3-1283 | AntiSense 19 mer | | UUUUAAGCUGAUAAUUCAA | 330 |

-continued

SEQUENCE LISTING

| Name | Description | Species | Sequence | SEQ ID NO |
|---|---|---|---|---|
| STAT3-1284 | AntiSense 19 mer | | AUUUUAAGCUGAUAAUUCA | 331 |
| STAT3-1286 | AntiSense 19 mer | | UAAUUUUAAGCUGAUAAUU | 332 |
| STAT3-1287 | AntiSense 19 mer | | UUAAUUUUAAGCUGAUAAU | 333 |
| STAT3-1292 | AntiSense 19 mer | | ACACUUUAAUUUUAAGCUG | 334 |
| STAT3-1293 | AntiSense 19 mer | | CACACUUUAAUUUUAAGCU | 335 |
| STAT3-1299 | AntiSense 19 mer | | UCAAUGCACACUUUAAUUU | 336 |
| STAT3-1305 | AntiSense 19 mer | | UCUUUGUCAAUGCACACUU | 337 |
| STAT3-1383 | AntiSense 19 mer | | UCCAUGUUCAUCACUUUUG | 338 |
| STAT3-1388 | AntiSense 19 mer | | AUUCUUCCAUGUUCAUCAC | 339 |
| STAT3-1427 | AntiSense 19 mer | | UCAAGUGUUUGAAUUCUGC | 340 |
| STAT3-1485 | AntiSense 19 mer | | AUCAGGGAAGCAUCACAAU | 341 |
| STAT3-1584 | AntiSense 19 mer | | AUCACCACAACUGGCAAGG | 342 |
| STAT3-1586 | AntiSense 19 mer | | AGAUCACCACAACUGGCAA | 343 |
| STAT3-1670 | AntiSense 19 mer | | AAAAGUUUACAUUCUUGGG | 344 |
| STAT3-1671 | AntiSense 19 mer | | AAAAAGUUUACAUUCUUGG | 345 |
| STAT3-1672 | AntiSense 19 mer | | AAAAAAGUUUACAUUCUUG | 346 |
| STAT3-1673 | AntiSense 19 mer | | UAAAAAAGUUUACAUUCUU | 347 |
| STAT3-1674 | AntiSense 19 mer | | GUAAAAAAGUUUACAUUCU | 348 |
| STAT3-1676 | AntiSense 19 mer | | UGGUAAAAAAGUUUACAUU | 349 |
| STAT3-1813 | AntiSense 19 mer | | UGAAUAAUUCACACCAGGU | 350 |
| STAT3-1815 | AntiSense 19 mer | | CCUGAAUAAUUCACACCAG | 35 |
| STAT3-1817 | AntiSense 19 mer | | ACCCUGAAUAAUUCACACC | 352 |
| STAT3-1819 | AntiSense 19 mer | | ACACCCUGAAUAAUUCACA | 353 |
| STAT3-1904 | AntiSense 19 mer | | GGUCAAUGAUAUUGUCCAG | 354 |
| STAT3-1906 | AntiSense 19 mer | | AAGGUCAAUGAUAUUGUCC | 355 |
| STAT3-1907 | AntiSense 19 mer | | CAAGGUCAAUGAUAUUGUC | 356 |
| STAT3-1908 | AntiSense 19 mer | | ACAAGGUCAAUGAUAUUGU | 357 |
| STAT3-1909 | AntiSense 19 mer | | CACAAGGUCAAUGAUAUUG | 358 |
| STAT3-1910 | AntiSense 19 mer | | UCACAAGGUCAAUGAUAUU | 359 |
| STAT3-1911 | AntiSense 19 mer | | UUCACAAGGUCAAUGAUAU | 360 |
| STAT3-1912 | AntiSense 19 mer | | UUUCACAAGGUCAAUGAUA | 361 |
| STAT3-1913 | AntiSense 19 mer | | UUUUCACAAGGUCAAUGAU | 362 |
| STAT3-1914 | AntiSense 19 mer | | UUUUUCACAAGGUCAAUGA | 363 |
| STAT3-1916 | AntiSense 19 mer | | ACUUUUUCACAAGGUCAAU | 364 |
| STAT3-1917 | AntiSense 19 mer | | UACUUUUUCACAAGGUCAA | 365 |
| STAT3-1919 | AntiSense 19 mer | | UGUACUUUUUCACAAGGUC | 366 |
| STAT3-1920 | AntiSense 19 mer | | AUGUACUUUUUCACAAGGU | 367 |

-continued

SEQUENCE LISTING

| Name | Description | Species | Sequence | SEQ ID NO |
|---|---|---|---|---|
| STAT3-2024 | AntiSense 19 mer | | UGAAUCUUAGCAGGAAGGU | 368 |
| STAT3-2135 | AntiSense 19 mer | | UGUUGUUCAGCUGCUGCUU | 369 |
| STAT3-2136 | AntiSense 19 mer | | AUGUUGUUCAGCUGCUGCU | 370 |
| STAT3-2138 | AntiSense 19 mer | | ACAUGUUGUUCAGCUGCUG | 371 |
| STAT3-2139 | AntiSense 19 mer | | GACAUGUUGUUCAGCUGCU | 372 |
| STAT3-2143 | AntiSense 19 mer | | AAAUGACAUGUUGUUCAGC | 373 |
| STAT3-2144 | AntiSense 19 mer | | CAAAUGACAUGUUGUUCAG | 374 |
| STAT3-2145 | AntiSense 19 mer | | GCAAAUGACAUGUUGUUCA | 375 |
| STAT3-2146 | AntiSense 19 mer | | AGCAAAUGACAUGUUGUUC | 376 |
| STAT3-2147 | AntiSense 19 mer | | CAGCAAAUGACAUGUUGUU | 377 |
| STAT3-2148 | AntiSense 19 mer | | UCAGCAAAUGACAUGUUGU | 378 |
| STAT3-2151 | AntiSense 19 mer | | AUUUCAGCAAAUGACAUGU | 379 |
| STAT3-2153 | AntiSense 19 mer | | UGAUUUCAGCAAAUGACAU | 380 |
| STAT3-2154 | AntiSense 19 mer | | AUGAUUUCAGCAAAUGACA | 381 |
| STAT3-2159 | AntiSense 19 mer | | CCAUGAUGAUUUCAGCAAA | 382 |
| STAT3-2322 | AntiSense 19 mer | | AACUUGGUCUUCAGGUAUG | 383 |
| STAT3-2325 | AntiSense 19 mer | | AUAAACUUGGUCUUCAGGU | 384 |
| STAT3-2327 | AntiSense 19 mer | | AGAUAAACUUGGUCUUCAG | 385 |
| STAT3-2329 | AntiSense 19 mer | | ACAGAUAAACUUGGUCUUC | 386 |
| STAT3-2333 | AntiSense 19 mer | | UCACACAGAUAAACUUGGU | 387 |
| STAT3-2335 | AntiSense 19 mer | | UGUCACACAGAUAAACUUG | 388 |
| STAT3-2404 | AntiSense 19 mer | | AAACUGCAUCAAUGAAUCU | 389 |
| STAT3-2405 | AntiSense 19 mer | | CAAACUGCAUCAAUGAAUC | 390 |
| STAT3-2407 | AntiSense 19 mer | | UCCAAACUGCAUCAAUGAA | 391 |
| STAT3-2408 | AntiSense 19 mer | | UUCCAAACUGCAUCAAUGA | 392 |
| STAT3-2411 | AntiSense 19 mer | | UAUUUCCAAACUGCAUCAA | 393 |
| STAT3-2412 | AntiSense 19 mer | | UUAUUUCCAAACUGCAUCA | 394 |
| STAT3-2413 | AntiSense 19 mer | | AUUAUUUCCAAACUGCAUC | 395 |
| STAT3-2416 | AntiSense 19 mer | | ACCAUUAUUUCCAAACUGC | 396 |
| STAT3-2418 | AntiSense 19 mer | | UCACCAUUAUUUCCAAACU | 397 |
| STAT3-2422 | AntiSense 19 mer | | ACCUUCACCAUUAUUUCCA | 398 |
| STAT3-2427 | AntiSense 19 mer | | UCAGCACCUUCACCAUUAU | 399 |
| STAT3-2612 | AntiSense 19 mer | | ACAAAGUUAGUAGUUUCAG | 400 |
| STAT3-2615 | AntiSense 19 mer | | ACCACAAAGUUAGUAGUUU | 401 |
| STAT3-2616 | AntiSense 19 mer | | AACCACAAAGUUAGUAGUU | 402 |
| STAT3-2617 | AntiSense 19 mer | | GAACCACAAAGUUAGUAGU | 403 |

-continued

SEQUENCE LISTING

| Name | Description | Species | Sequence | SEQ ID NO |
|---|---|---|---|---|
| STAT3-2622 | AntiSense 19 mer | | AUCUGGAACCACAAAGUUA | 404 |
| STAT3-2625 | AntiSense 19 mer | | AAAAUCUGGAACCACAAAG | 405 |
| STAT3-2626 | AntiSense 19 mer | | AAAAAUCUGGAACCACAAA | 406 |
| STAT3-2627 | AntiSense 19 mer | | AAAAAAUCUGGAACCACAA | 407 |
| STAT3-2692 | AntiSense 19 mer | | UUCACUCAUUUCUCUAUUU | 408 |
| STAT3-2693 | AntiSense 19 mer | | AUUCACUCAUUUCUCUAUU | 409 |
| STAT3-2715 | AntiSense 19 mer | | UAGAUAAAAGCAGAUCACC | 410 |
| STAT3-2719 | AntiSense 19 mer | | CAUUUAGAUAAAAGCAGAU | 411 |
| STAT3-2721 | AntiSense 19 mer | | UGCAUUUAGAUAAAAGCAG | 412 |
| STAT3-2735 | AntiSense 19 mer | | AACACAUCCUUAUUUGCAU | 413 |
| STAT3-2741 | AntiSense 19 mer | | UCAGAGAACACAUCCUUAU | 414 |
| STAT3-2801 | AntiSense 19 mer | | ACAAGACAUUUCCUUUUUC | 415 |
| STAT3-2803 | AntiSense 19 mer | | ACACAAGACAUUUCCUUUU | 416 |
| STAT3-2804 | AntiSense 19 mer | | AACACAAGACAUUUCCUUU | 417 |
| STAT3-2806 | AntiSense 19 mer | | ACAACACAAGACAUUUCCU | 418 |
| STAT3-2807 | AntiSense 19 mer | | AACAACACAAGACAUUUCC | 419 |
| STAT3-2808 | AntiSense 19 mer | | AAACAACACAAGACAUUUC | 420 |
| STAT3-2809 | AntiSense 19 mer | | AAAACAACACAAGACAUUU | 421 |
| STAT3-2810 | AntiSense 19 mer | | CAAAACAACACAAGACAUU | 422 |
| STAT3-2811 | AntiSense 19 mer | | ACAAAACAACACAAGACAU | 423 |
| STAT3-2812 | AntiSense 19 mer | | AACAAAACAACACAAGACA | 424 |
| STAT3-2813 | AntiSense 19 mer | | GAACAAAACAACACAAGAC | 425 |
| STAT3-2846 | AntiSense 19 mer | | AUAACAAAAAGCUGCUGAG | 426 |
| STAT3-2848 | AntiSense 19 mer | | CAAUAACAAAAAGCUGCUG | 427 |
| STAT3-2849 | AntiSense 19 mer | | ACAAUAACAAAAAGCUGCU | 428 |
| STAT3-2850 | AntiSense 19 mer | | AACAAUAACAAAAAGCUGC | 429 |
| STAT3-2851 | AntiSense 19 mer | | CAACAAUAACAAAAAGCUG | 430 |
| STAT3-2852 | AntiSense 19 mer | | ACAACAAUAACAAAAAGCU | 431 |
| STAT3-2853 | AntiSense 19 mer | | AACAACAAUAACAAAAAGC | 432 |
| STAT3-2854 | AntiSense 19 mer | | CAACAACAAUAACAAAAAG | 433 |
| STAT3-2855 | AntiSense 19 mer | | ACAACAACAAUAACAAAAA | 434 |
| STAT3-2856 | AntiSense 19 mer | | AACAACAACAAUAACAAAA | 435 |
| STAT3-2857 | AntiSense 19 mer | | CAACAACAACAAUAACAAA | 436 |
| STAT3-2858 | AntiSense 19 mer | | ACAACAACAACAAUAACAA | 437 |
| STAT3-2859 | AntiSense 19 mer | | AACAACAACAACAAUAACA | 438 |
| STAT3-2860 | AntiSense 19 mer | | GAACAACAACAACAAUAAC | 439 |
| STAT3-2861 | AntiSense 19 mer | | AGAACAACAACAACAAUAA | 440 |

-continued

SEQUENCE LISTING

| Name | Description | Species | Sequence | SEQ ID NO |
|---|---|---|---|---|
| STAT3-2862 | AntiSense 19 mer | | AAGAACAACAACAACAAUA | 441 |
| STAT3-2863 | AntiSense 19 mer | | UAAGAACAACAACAACAAU | 442 |
| STAT3-2865 | AntiSense 19 mer | | UCUAAGAACAACAACAACA | 443 |
| STAT3-2867 | AntiSense 19 mer | | UGUCUAAGAACAACAACAA | 444 |
| STAT3-2868 | AntiSense 19 mer | | UUGUCUAAGAACAACAACA | 445 |
| STAT3-2975 | AntiSense 19 mer | | UGUCAGCAAGGUUAAAAAG | 446 |
| STAT3-2979 | AntiSense 19 mer | | UGGAUGUCAGCAAGGUUAA | 447 |
| STAT3-2985 | AntiSense 19 mer | | UCUAUUUGGAUGUCAGCAA | 448 |
| STAT3-3025 | AntiSense 19 mer | | UUAAUUUAAAAAGAAACCU | 449 |
| STAT3-3037 | AntiSense 19 mer | | UGUUAUUAUUUCUUAAUUU | 450 |
| STAT3-3038 | AntiSense 19 mer | | UUGUUAUUAUUUCUUAAUU | 451 |
| STAT3-3039 | AntiSense 19 mer | | AUUGUUAUUAUUUCUUAAU | 452 |
| STAT3-3041 | AntiSense 19 mer | | UAAUUGUUAUUAUUUCUUA | 453 |
| STAT3-3042 | AntiSense 19 mer | | UUAAUUGUUAUUAUUUCUU | 454 |
| STAT3-3043 | AntiSense 19 mer | | UUUAAUUGUUAUUAUUUCU | 455 |
| STAT3-3225 | AntiSense 19 mer | | AAUUUUUUGUACUUUUAGU | 456 |
| STAT3-3226 | AntiSense 19 mer | | UAAUUUUUUGUACUUUUAG | 457 |
| STAT3-3605 | AntiSense 19 mer | | UACAAAGGAAAAUAAGUCU | 458 |
| STAT3-3611 | AntiSense 19 mer | | AUACAUUACAAAGGAAAAU | 459 |
| STAT3-3906 | AntiSense 19 mer | | UCAUGUCCAACCUGUAACU | 460 |
| STAT3-4311 | AntiSense 19 mer | | UAACAAACAGAAUUCCACA | 461 |
| STAT3-4314 | AntiSense 19 mer | | AUUUAACAAACAGAAUUCC | 462 |
| STAT3-4317 | AntiSense 19 mer | | UUGAUUUAACAAACAGAAU | 463 |
| STAT3-4321 | AntiSense 19 mer | | UAAUUUGAUUUAACAAACA | 464 |
| STAT3-4465 | AntiSense 19 mer | | UCAGUUAAGCUUAUUAUGU | 465 |
| STAT3-4479 | AntiSense 19 mer | | AAAUAUUCUGUUUAUCAGU | 466 |
| STAT3-4480 | AntiSense 19 mer | | UAAAUAUUCUGUUUAUCAG | 467 |
| STAT3-4831 | AntiSense 19 mer | | AAUAUAAAUUUUUACACUA | 468 |
| STAT3-4833 | AntiSense 19 mer | | AUAAUAUAAAUUUUUACAC | 469 |
| STAT3-4836 | AntiSense 19 mer | | ACAAUAAUAUAAAUUUUUA | 470 |
| STAT3-4837 | AntiSense 19 mer | | CACAAUAAUAUAAAUUUUU | 471 |
| STAT3-4909 | AntiSense 19 mer | | UUUAUUUCUGGAAGUUAAA | 472 |
| STAT3-370 | 25 mer SenseStrand | | CACUUUGGUGUUUCAUAAUAGCAGC | 473 |
| STAT3-372 | 25 mer SenseStrand | | CUUUGGUGUUUCAUAAUCUAGCAGC | 474 |
| STAT3-424 | 25 mer SenseStrand | | CCUGCAAGAGUCGAAUGUUAGCAGC | 475 |
| STAT3-425 | 25 mer SenseStrand | | CUGCAAGAGUCGAAUGUUCAGCAGC | 476 |

-continued

SEQUENCE LISTING

| Name | Description | Species | Sequence | SEQ ID NO |
|---|---|---|---|---|
| STAT3-426 | 25 mer SenseStrand | | UGCAAGAGUCGAAUGUUCUAGCAGC | 477 |
| STAT3-429 | 25 mer SenseStrand | | AAGAGUCGAAUGUUCUCUAAGCAGC | 478 |
| STAT3-430 | 25 mer SenseStrand | | AGAGUCGAAUGUUCUCUAUAGCAGC | 479 |
| STAT3-432 | 25 mer SenseStrand | | AGUCGAAUGUUCUCUAUCAAGCAGC | 480 |
| STAT3-433 | 25 mer SenseStrand | | GUCGAAUGUUCUCUAUCAGAGCAGC | 481 |
| STAT3-460 | 25 mer Sense Strand | | ACGAAGAAUCAAGCAGUUUAGCAGC | 482 |
| STAT3-461 | 25 mer Sense Strand | | CGAAGAAUCAAGCAGUUUCAGCAGC | 483 |
| STAT3-462 | 25 mer Sense Strand | | GAAGAAUCAAGCAGUUUCUAGCAGC | 484 |
| STAT3-492 | 25 mer Sense Strand | | AUCUUGAGAAGCCAAUGGAAGCAGC | 485 |
| STAT3-678 | 25 mer Sense Strand | | AGGAUCUAGAACAGAAAAUAGCAGC | 486 |
| STAT3-681 | 25 mer Sense Strand | | AUCUAGAACAGAAAAUGAAAGCAGC | 487 |
| STAT3-715 | 25 mer Sense Strand | | CCAGGAUGACUUUGAUUUCAGCAGC | 488 |
| STAT3-716 | 25 mer Sense Strand | | CAGGAUGACUUUGAUUUCAAGCAGC | 489 |
| STAT3-717 | 25 mer Sense Strand | | AGGAUGACUUUGAUUUCAAAGCAGC | 490 |
| STAT3-720 | 25 mer Sense Strand | | AUGACUUUGAUUUCAACUAAGCAGC | 491 |
| STAT3-721 | 25 mer Sense Strand | | UGACUUUGAUUUCAACUAUAGCAGC | 492 |
| STAT3-722 | 25 mer Sense Strand | | GACUUUGAUUUCAACUAUAAGCAGC | 493 |
| STAT3-723 | 25 mer Sense Strand | | ACUUUGAUUUCAACUAUAAAGCAGC | 494 |
| STAT3-724 | 25 mer Sense Strand | | CUUUGAUUUCAACUAUAAAAGCAGC | 495 |
| STAT3-768 | 25 mer Sense Strand | | AAGAUCUGAAUGGAAACAAAGCAGC | 496 |
| STAT3-771 | 25 mer Sense Strand | | AUCUGAAUGGAAACAACCAAGCAGC | 497 |
| STAT3-773 | 25 mer Sense Strand | | CUGAAUGGAAACAACCAGUAGCAGC | 498 |
| STAT3-1000 | 25 mer Sense Strand | | AGAAAACUGGAUAACGUCAAGCAGC | 499 |
| STAT3-1001 | 25 mer Sense Strand | | GAAAACUGGAUAACGUCAUAGCAGC | 500 |
| STAT3-1003 | 25 mer Sense Strand | | AAACUGGAUAACGUCAUUAAGCAGC | 501 |
| STAT3-1006 | 25 mer Sense Strand | | CUGGAUAACGUCAUUAGCAAGCAGC | 502 |
| STAT3-1008 | 25 mer Sense Strand | | GGAUAACGUCAUUAGCAGAAGCAGC | 503 |

SEQUENCE LISTING

| Name | Description | Species | Sequence | SEQ ID NO |
|---|---|---|---|---|
| STAT3-1009 | 25 mer Sense Strand | | GAUAACGUCAUUAGCAGAAAGCAGC | 504 |
| STAT3-1010 | 25 mer Sense Strand | | AUAACGUCAUUAGCAGAAUAGCAGC | 505 |
| STAT3-1047 | 25 mer Sense Strand | | AACAAAUUAAGAAACUGGAAGCAGC | 506 |
| STAT3-1067 | 25 mer Sense Strand | | GAGUUGCAGCAAAAAGUUUAGCAGC | 507 |
| STAT3-1068 | 25 mer Sense Strand | | AGUUGCAGCAAAAAGUUUCAGCAGC | 508 |
| STAT3-1145 | 25 mer Sense Strand | | CUGUUUAGAAACUUAAUGAAGCAGC | 509 |
| STAT3-1151 | 25 mer Sense Strand | | AGAAACUUAAUGAAAAGUGAGCAGC | 510 |
| STAT3-1241 | 25 mer Sense Strand | | CAGUUCACUACUAAAGUCAAGCAGC | 511 |
| STAT3-1268 | 25 mer Sense Strand | | GUCAAAUUCCCUGAGUUGAAGCAGC | 512 |
| STAT3-1272 | 25 mer Sense Strand | | AAUUCCCUGAGUUGAAUUAAGCAGC | 513 |
| STAT3-1273 | 25 mer Sense Strand | | AUUCCCUGAGUUGAAUUAUAGCAGC | 514 |
| STAT3-1275 | 25 mer Sense Strand | | UCCCUGAGUUGAAUUAUCAAGCAGC | 515 |
| STAT3-1277 | 25 mer Sense Strand | | CCUGAGUUGAAUUAUCAGCAGCAGC | 516 |
| STAT3-1278 | 25 mer Sense Strand | | CUGAGUUGAAUUAUCAGCUAGCAGC | 517 |
| STAT3-1279 | 25 mer Sense Strand | | UGAGUUGAAUUAUCAGCUUAGCAGC | 518 |
| STAT3-1280 | 25 mer Sense Strand | | GAGUUGAAUUAUCAGCUUAAGCAGC | 519 |
| STAT3-1281 | 25 mer Sense Strand | | AGUUGAAUUAUCAGCUUAAAGCAGC | 520 |
| STAT3-1282 | 25 mer Sense Strand | | GUUGAAUUAUCAGCUUAAAAGCAGC | 521 |
| STAT3-1283 | 25 mer Sense Strand | | UUGAAUUAUCAGCUUAAAAAGCAGC | 522 |
| STAT3-1284 | 25 mer Sense Strand | | UGAAUUAUCAGCUUAAAAUAGCAGC | 523 |
| STAT3-1286 | 25 mer Sense Strand | | AAUUAUCAGCUUAAAAUUAAGCAGC | 524 |
| STAT3-1287 | 25 mer Sense Strand | | AUUAUCAGCUUAAAAUUAAAGCAGC | 525 |
| STAT3-1292 | 25 mer Sense Strand | | CAGCUUAAAAUUAAAGUGUAGCAGC | 526 |
| STAT3-1293 | 25 mer Sense Strand | | AGCUUAAAAUUAAAGUGUGAGCAGC | 527 |
| STAT3-1299 | 25 mer Sense Strand | | AAAUUAAAGUGUGCAUUGAAGCAGC | 528 |

-continued

| SEQUENCE LISTING | | | | |
|---|---|---|---|---|
| Name | Description | Species | Sequence | SEQ ID NO |
| STAT3-1305 | 25 mer Sense Strand | | AAGUGUGCAUUGACAAAGAAGCAGC | 529 |
| STAT3-1383 | 25 mer Sense Strand | | CAAAAGUGAUGAACAUGGAAGCAGC | 530 |
| STAT3-1388 | 25 mer Sense Strand | | GUGAUGAACAUGGAAGAAUAGCAGC | 531 |
| STAT3-1427 | 25 mer Sense Strand | | GCAGAAUUCAAACACUUGAAGCAGC | 532 |
| STAT3-1485 | 25 mer Sense Strand | | AUUGUGAUGCUUCCCUGAUAGCAGC | 533 |
| STAT3-1584 | 25 mer Sense Strand | | CCUUGCCAGUUGUGGUGAUAGCAGC | 534 |
| STAT3-1586 | 25 mer Sense Strand | | UUGCCAGUUGUGGUGAUCUAGCAGC | 535 |
| STAT3-1670 | 25 mer Sense Strand | | CCCAAGAAUGUAAACUUUUAGCAGC | 536 |
| STAT3-1671 | 25 mer Sense Strand | | CCAAGAAUGUAAACUUUUUAGCAGC | 537 |
| STAT3-1672 | 25 mer Sense Strand | | CAAGAAUGUAAACUUUUUUAGCAGC | 538 |
| STAT3-1673 | 25 mer Sense Strand | | AAGAAUGUAAACUUUUUUAAGCAGC | 539 |
| STAT3-1674 | 25 mer Sense Strand | | AGAAUGUAAACUUUUUUACAGCAGC | 540 |
| STAT3-1676 | 25 mer Sense Strand | | AAUGUAAACUUUUUUACCAAGCAGC | 541 |
| STAT3-1813 | 25 mer Sense Strand | | ACCUGGUGUGAAUUAUUCAAGCAGC | 542 |
| STAT3-1815 | 25 mer Sense Strand | | CUGGUGUGAAUUAUUCAGGAGCAGC | 543 |
| STAT3-1817 | 25 mer Sense Strand | | GGUGUGAAUUAUUCAGGGUAGCAGC | 544 |
| STAT3-1819 | 25 mer Sense Strand | | UGUGAAUUAUUCAGGGUGUAGCAGC | 545 |
| STAT3-1904 | 25 mer Sense Strand | | CUGGACAAUAUCAUUGACCAGCAGC | 546 |
| STAT3-1906 | 25 mer Sense Strand | | GGACAAUAUCAUUGACCUUAGCAGC | 547 |
| STAT3-1907 | 25 mer Sense Strand | | GACAAUAUCAUUGACCUUGAGCAGC | 548 |
| STAT3-1908 | 25 mer Sense Strand | | ACAAUAUCAUUGACCUUGUAGCAGC | 549 |
| STAT3-1909 | 25 mer Sense Strand | | CAAUAUCAUUGACCUUGUGAGCAGC | 550 |
| STAT3-1910 | 25 mer Sense Strand | | AAUAUCAUUGACCUUGUGAAGCAGC | 551 |
| STAT3-1911 | 25 mer Sense Strand | | AUAUCAUUGACCUUGUGAAAGCAGC | 552 |
| STAT3-1912 | 25 mer Sense Strand | | UAUCAUUGACCUUGUGAAAAGCAGC | 553 |

-continued

SEQUENCE LISTING

| Name | Description | Species | Sequence | SEQ ID NO |
|---|---|---|---|---|
| STAT3-1913 | 25 mer Sense Strand | | AUCAUUGACCUUGUGAAAAAGCAGC | 554 |
| STAT3-1914 | 25 mer Sense Strand | | UCAUUGACCUUGUGAAAAAAGCAGC | 555 |
| STAT3-1916 | 25 mer Sense Strand | | AUUGACCUUGUGAAAAAGUAGCAGC | 556 |
| STAT3-1917 | 25 mer SenseStrand | | UUGACCUUGUGAAAAAGUAAGCAGC | 557 |
| STAT3-1919 | 25 mer Sense Strand | | GACCUUGUGAAAAAGUACAAGCAGC | 558 |
| STAT3-1920 | 25 mer Sense Strand | | ACCUUGUGAAAAAGUACAUAGCAGC | 559 |
| STAT3-2024 | 25 mer Sense Strand | | ACCUUCCUGCUAAGAUUCAAGCAGC | 560 |
| STAT3-2135 | 25 mer Sense Strand | | AAGCAGCAGCUGAACAACAAGCAGC | 561 |
| STAT3-2136 | 25 mer Sense Strand | | AGCAGCAGCUGAACAACAUAGCAGC | 562 |
| STAT3-2138 | 25 mer Sense Strand | | CAGCAGCUGAACAACAUGUAGCAGC | 563 |
| STAT3-2139 | 25 mer Sense Strand | | AGCAGCUGAACAACAUGUCAGCAGC | 564 |
| STAT3-2143 | 25 mer Sense Strand | | GCUGAACAACAUGUCAUUUAGCAGC | 565 |
| STAT3-2144 | 25 mer Sense Strand | | CUGAACAACAUGUCAUUUGAGCAGC | 568 |
| STAT3-2145 | 25 mer Sense Strand | | UGAACAACAUGUCAUUUGCAGCAGC | 567 |
| STAT3-2146 | 25 mer Sense Strand | | GAACAACAUGUCAUUUGCUAGCAGC | 568 |
| STAT3-2147 | 25 mer Sense Strand | | AACAACAUGUCAUUUGCUGAGCAGC | 569 |
| STAT3-2148 | 25 mer Sense Strand | | ACAACAUGUCAUUUGCUGAAGCAGC | 570 |
| STAT3-2151 | 25 mer Sense Strand | | ACAUGUCAUUUGCUGAAAUAGCAGC | 571 |
| STAT3-2153 | 25 mer Sense Strand | | AUGUCAUUUGCUGAAAUCAAGCAGC | 572 |
| STAT3-2154 | 25 mer Sense Strand | | UGUCAUUUGCUGAAAUCAUAGCAGC | 573 |
| STAT3-2159 | 25 mer Sense Strand | | UUUGCUGAAAUCAUCAUGGAGCAGC | 574 |
| STAT3-2322 | 25 mer Sense Strand | | CAUACCUGAAGACCAAGUUAGCAGC | 575 |
| STAT3-2325 | 25 mer Sense Strand | | ACCUGAAGACCAAGUUUAUAGCAGC | 576 |
| STAT3-2327 | 25 mer Sense Strand | | CUGAAGACCAAGUUUAUCUAGCAGC | 577 |
| STAT3-2329 | 25 mer Sense Strand | | GAAGACCAAGUUUAUCUGUAGCAGC | 578 |

-continued

SEQUENCE LISTING

| Name | Description | Species | Sequence | SEQ ID NO |
|---|---|---|---|---|
| STAT3-2333 | 25 mer Sense Strand | | ACCAAGUUUAUCUGUGUGAAGCAGC | 579 |
| STAT3-2335 | 25 mer Sense Strand | | CAAGUUUAUCUGUGUGACAAGCAGC | 580 |
| STAT3-2404 | 25 mer Sense Strand | | AGAUUCAUUGAUGCAGUUUAGCAGC | 581 |
| STAT3-2405 | 25 mer Sense Strand | | GAUUCAUUGAUGCAGUUUGAGCAGC | 582 |
| STAT3-2407 | 25 mer Sense Strand | | UUCAUUGAUGCAGUUUGGAAGCAGC | 583 |
| STAT3-2408 | 25 mer Sense Strand | | UCAUUGAUGCAGUUUGGAAAGCAGC | 584 |
| STAT3-2411 | 25 mer Sense Strand | | UUGAUGCAGUUUGGAAAUAAGCAGC | 585 |
| STAT3-2412 | 25 mer Sense Strand | | UGAUGCAGUUUGGAAAUAAAGCAGC | 586 |
| STAT3-2413 | 25 mer Sense Strand | | GAUGCAGUUUGGAAAUAAUAGCAGC | 587 |
| STAT3-2416 | 25 mer Sense Strand | | GCAGUUUGGAAAUAAUGGUAGCAGC | 588 |
| STAT3-2418 | 25 mer Sense Strand | | AGUUUGGAAAUAAUGGUGAAGCAGC | 589 |
| STAT3-2422 | 25 mer Sense Strand | | UGGAAAUAAUGGUGAAGGUAGCAGC | 590 |
| STAT3-2427 | 25 mer Sense Strand | | AUAAUGGUGAAGGUGCUGAAGCAGC | 591 |
| STAT3-2612 | 25 mer Sense Strand | | CUGAAACUACUAACUUUGUAGCAGC | 592 |
| STAT3-2615 | 25 mer Sense Strand | | AAACUACUAACUUUGUGGUAGCAGC | 593 |
| STAT3-2616 | 25 mer Sense Strand | | AACUACUAACUUUGUGGUUAGCAGC | 594 |
| STAT3-2617 | 25 mer Sense Strand | | ACUACUAACUUUGUGGUUCAGCAGC | 595 |
| STAT3-2622 | 25 mer Sense Strand | | UAACUUUGUGGUUCCAGAUAGCAGC | 596 |
| STAT3-2625 | 25 mer Sense Strand | | CUUUGUGGUUCCAGAUUUUAGCAGC | 597 |
| STAT3-2626 | 25 mer Sense Strand | | UUUGUGGUUCCAGAUUUUUAGCAGC | 598 |
| STAT3-2627 | 25 mer Sense Strand | | UUGUGGUUCCAGAUUUUUUAGCAGC | 599 |
| STAT3-2692 | 25 mer Sense Strand | | AAAUAGAGAAAUGAGUGAAAGCAGC | 600 |
| STAT3-2693 | 25 mer Sense Strand | | AAUAGAGAAAUGAGUGAAUAGCAGC | 601 |
| STAT3-2715 | 25 mer Sense Strand | | GGUGAUCUGCUUUUAUCUAAGCAGC | 602 |
| STAT3-2719 | 25 mer Sense Strand | | AUCUGCUUUUAUCUAAAUGAGCAGC | 603 |

-continued

SEQUENCE LISTING

| Name | Description | Species | Sequence | SEQ ID NO |
|---|---|---|---|---|
| STAT3-2721 | 25 mer Sense Strand | | CUGCUUUUAUCUAAAUGCAAGCAGC | 604 |
| STAT3-2735 | 25 mer Sense Strand | | AUGCAAAUAAGGAUGUGUUAGCAGC | 605 |
| STAT3-2741 | 25 mer Sense Strand | | AUAAGGAUGUGUUCUCUGAAGCAGC | 606 |
| STAT3-2801 | 25 mer Sense Strand | | GAAAAAGGAAAUGUCUUGUAGCAGC | 607 |
| STAT3-2803 | 25 mer Sense Strand | | AAAAGGAAAUGUCUUGUGUAGCAGC | 608 |
| STAT3-2804 | 25 mer Sense Strand | | AAAGGAAAUGUCUUGUGUUAGCAGC | 609 |
| STAT3-2806 | 25 mer Sense Strand | | AGGAAAUGUCUUGUGUUGUAGCAGC | 610 |
| STAT3-2807 | 25 mer Sense Strand | | GGAAAUGUCUUGUGUUGUUAGCAGC | 611 |
| STAT3-2808 | 25 mer Sense Strand | | GAAAUGUCUUGUGUUGUUUAGCAGC | 612 |
| STAT3-2809 | 25 mer Sense Strand | | AAAUGUCUUGUGUUGUUUUAGCAGC | 613 |
| STAT3-2810 | 25 mer Sense Strand | | AAUGUCUUGUGUUGUUUUGAGCAGC | 614 |
| STAT3-2811 | 25 mer Sense Strand | | AUGUCUUGUGUUGUUUUGUAGCAGC | 615 |
| STAT3-2812 | 25 mer Sense Strand | | UGUCUUGUGUUGUUUUGUUAGCAGC | 616 |
| STAT3-2813 | 25 mer Sense Strand | | GUCUUGUGUUGUUUUGUUCAGCAGC | 617 |
| STAT3-2846 | 25 mer Sense Strand | | CUCAGCAGCUUUUUGUUAUAGCAGC | 618 |
| STAT3-2848 | 25 mer Sense Strand | | CAGCAGCUUUUUGUUAUUGAGCAGC | 619 |
| STAT3-2849 | 25 mer Sense Strand | | AGCAGCUUUUUGUUAUUGUAGCAGC | 620 |
| STAT3-2850 | 25 mer Sense Strand | | GCAGCUUUUUGUUAUUGUUAGCAGC | 621 |
| STAT3-2851 | 25 mer Sense Strand | | CAGCUUUUUGUUAUUGUUGAGCAGC | 622 |
| STAT3-2852 | 25 mer Sense Strand | | AGCUUUUUGUUAUUGUUGUAGCAGC | 623 |
| STAT3-2853 | 25 mer Sense Strand | | GCUUUUUGUUAUUGUUGUUAGCAGC | 624 |
| STAT3-2854 | 25 mer Sense Strand | | CUUUUUGUUAUUGUUGUUGAGCAGC | 625 |
| STAT3-2855 | 25 mer Sense Strand | | UUUUUGUUAUUGUUGUUGUAGCAGC | 626 |
| STAT3-2856 | 25 mer Sense Strand | | UUUUGUUAUUGUUGUUGUUAGCAGC | 627 |

-continued

SEQUENCE LISTING

| Name | Description | Species | Sequence | SEQ ID NO |
|---|---|---|---|---|
| STAT3-2857 | 25 mer Sense Strand | | UUUGUUAUUGUUGUUGUUGAGCAGC | 628 |
| STAT3-2858 | 25 mer Sense Strand | | UUGUUAUUGUUGUUGUUGUAGCAGC | 629 |
| STAT3-2859 | 25 mer Sense Strand | | UGUUAUUGUUGUUGUUGUUAGCAGC | 630 |
| STAT3-2860 | 25 mer Sense Strand | | GUUAUUGUUGUUGUUGUUCAGCAGC | 631 |
| STAT3-2861 | 25 mer Sense Strand | | UUAUUGUUGUUGUUGUUCUAGCAGC | 632 |
| STAT3-2862 | 25 mer Sense Strand | | UAUUGUUGUUGUUGUUCUUAGCAGC | 633 |
| STAT3-2863 | 25 mer Sense Strand | | AUUGUUGUUGUUGUUCUUAAGCAGC | 634 |
| STAT3-2865 | 25 mer Sense Strand | | UGUUGUUGUUGUUCUUAGAAGCAGC | 635 |
| STAT3-2867 | 25 mer Sense Strand | | UUGUUGUUGUUCUUAGACAAGCAGC | 636 |
| STAT3-2868 | 25 mer Sense Strand | | UGUUGUUGUUCUUAGACAAAGCAGC | 637 |
| STAT3-2975 | 25 mer Sense Strand | | CUUUUUAACCUUGCUGACAAGCAGC | 638 |
| STAT3-2979 | 25 mer Sense Strand | | UUAACCUUGCUGACAUCCAAGCAGC | 639 |
| STAT3-2985 | 25 mer Sense Strand | | UUGCUGACAUCCAAAUAGAAGCAGC | 640 |
| STAT3-3025 | 25 mer Sense Strand | | AGGUUUUUUUUAAAUUAAAGCAGC | 641 |
| STAT3-3037 | 25 mer Sense Strand | | AAAUUAAGAAAUAAUAACAAGCAGC | 642 |
| STAT3-3038 | 25 mer Sense Strand | | AAUUAAGAAAUAAUAACAAAGCAGC | 643 |
| STAT3-3039 | 25 mer Sense Strand | | AUUAAGAAAUAAUAACAAUAGCAGC | 644 |
| STAT3-3041 | 25 mer Sense Strand | | UAAGAAAUAAUAACAAUUAAGCAGC | 645 |
| STAT3-3042 | 25 mer Sense Strand | | AAGAAAUAAUAACAAUUAAAGCAGC | 646 |
| STAT3-3043 | 25 mer Sense Strand | | AGAAAUAAUAACAAUUAAAAGCAGC | 647 |
| STAT3-3225 | 25 mer Sense Strand | | ACUAAAAGUACAAAAAAUUAGCAGC | 648 |
| STAT3-3226 | 25 mer Sense Strand | | CUAAAAGUACAAAAAAUUAAGCAGC | 649 |
| STAT3-3605 | 25 mer Sense Strand | | AGACUUAUUUUCCUUUGUAAGCAGC | 650 |
| STAT3-3611 | 25 mer Sense Strand | | AUUUUCCUUUGUAAUGUAUAGCAGC | 651 |
| STAT3-3906 | 25 mer Sense Strand | | AGUUACAGGUUGGACAUGAAGCAGC | 652 |
| STAT3-4311 | 25 mer Sense Strand | | UGUGGAAUUCUGUUUGUUAAGCAGC | 653 |
| STAT3-4314 | 25 mer Sense Strand | | GGAAUUCUGUUUGUUAAAUAGCAGC | 654 |
| STAT3-4317 | 25 mer Sense Strand | | AUUCUGUUUGUUAAAUCAAAGCAGC | 655 |
| STAT3-4321 | 25 mer Sense Strand | | UGUUUGUUAAAUCAAAUUAAGCAGC | 656 |

-continued

SEQUENCE LISTING

| Name | Description | Species | Sequence | SEQ ID NO |
|---|---|---|---|---|
| STAT3-4465 | 25 mer Sense Strand | | ACAUAAUAAGCUUAACUGAAGCAGC | 657 |
| STAT3-4479 | 25 mer Sense Strand | | ACUGAUAAACAGAAUAUUUAGCAGC | 658 |
| STAT3-4480 | 25 mer Sense Strand | | CUGAUAAACAGAAUAUUUAAGCAGC | 659 |
| STAT3-4831 | 25 mer Sense Strand | | UAGUGUAAAAAUUUAUAUUAGCAGC | 660 |
| STAT3-4833 | 25 mer Sense Strand | | GUGUAAAAAUUUAUAUUAUAGCAGC | 661 |
| STAT3-4836 | 25 mer Sense Strand | | UAAAAAUUUAUAUUAUUGUAGCAGC | 662 |
| STAT3-4837 | 25 mer Sense Strand | | AAAAAUUUAUAUUAUUGUGAGCAGC | 663 |
| STAT3-4909 | 25 mer Sense Strand | | UUUAACUUCCAGAAAUAAAAGCAGC | 664 |
| STAT3-370 | 27 mer Antisense Strand | | GCUGCUAUUAUGAAACACCAAAGUGGG | 665 |
| STAT3-372 | 27 mer Antisense Strand | | GCUGCUAGAUUAUGAAACACCAAAGGG | 666 |
| STAT3-424 | 27 mer Antisense Strand | | GCUGCUAACAUUCGACUCUUGCAGGGG | 667 |
| STAT3-425 | 27 mer Antisense Strand | | GCUGCUGAACAUUCGACUCUUGCAGGG | 668 |
| STAT3-426 | 27 mer Antisense Strand | | GCUGCUAGAACAUUCGACUCUUGCAGG | 669 |
| STAT3-429 | 27 mer Antisense Strand | | GCUGCUUAGAGAACAUUCGACUCUUGG | 670 |
| STAT3-430 | 27 mer Antisense Strand | | GCUGCUAUAGAGAACAUUCGACUCUGG | 671 |
| STAT3-432 | 27 mer Antisense Strand | | GCUGCUUGAUAGAGAACAUUCGACUGG | 672 |
| STAT3-433 | 27 mer Antisense Strand | | GCUGCUCUGAUAGAGAACAUUCGACGG | 673 |
| STAT3-460 | 27 mer Antisense Strand | | GCUGCUAAACUGCUUGAUUCUUCGUGG | 674 |
| STAT3-461 | 27 mer Antisense Strand | | GCUGCUGAAACUGCUUGAUUCUUCGGG | 675 |
| STAT3-462 | 27 mer Antisense Strand | | GCUGCUAGAAACUGCUUGAUUCUUCGG | 676 |
| STAT3-492 | 27 mer Antisense Strand | | GCUGCUUCCAUUGGCUUCUCAAGAUGG | 677 |
| STAT3-678 | 27 mer Antisense Strand | | GCUGCUAUUUUCUGUUCUAGAUCCUGG | 678 |
| STAT3-681 | 27 mer Antisense Strand | | GCUGCUUUCAUUUUCUGUUCUAGAUGG | 679 |
| STAT3-715 | 27 mer Antisense Strand | | GCUGCUGAAAUCAAAGUCAUCCUGGGG | 680 |
| STAT3-716 | 27 mer Antisense Strand | | GCUGCUUGAAAUCAAAGUCAUCCUGGG | 681 |

-continued

SEQUENCE LISTING

| Name | Description | Species | Sequence | SEQ ID NO |
|---|---|---|---|---|
| STAT3-717 | 27 mer Antisense Strand | | GCUGCUUUGAAAUCAAAGUCAUCCUGG | 682 |
| STAT3-720 | 27 mer Antisense Strand | | GCUGCUUAGUUGAAAUCAAAGUCAUGG | 683 |
| STAT3-721 | 27 mer Antisense Strand | | GCUGCUAUAGUUGAAAUCAAAGUCAGG | 684 |
| STAT3-722 | 27 mer Antisense Strand | | GCUGCUUAUAGUUGAAAUCAAAGUCGG | 685 |
| STAT3-723 | 27 mer Antisense Strand | | GCUGCUUUAUAGUUGAAAUCAAAGUGG | 686 |
| STAT3-724 | 27 mer Antisense Strand | | GCUGCUUUUAUAGUUGAAAUCAAAGGG | 687 |
| STAT3-768 | 27 mer Antisense Strand | | GCUGCUUUGUUUCCAUUCAGAUCUUGG | 688 |
| STAT3-771 | 27 mer Antisense Strand | | GCUGCUUGGUUGUUUCCAUUCAGAUGG | 689 |
| STAT3-773 | 27 mer Antisense Strand | | GCUGCUACUGGUUGUUUCCAUUCAGGG | 690 |
| STAT3-1000 | 27 mer Antisense Strand | | GCUGCUUGACGUUAUCCAGUUUUCUGG | 691 |
| STAT3-1001 | 27 mer Antisense Strand | | GCUGCUAUGACGUUAUCCAGUUUUCGG | 692 |
| STAT3-1003 | 27 mer Antisense Strand | | GCUGCUUAAUGACGUUAUCCAGUUUGG | 693 |
| STAT3-1006 | 27 mer Antisense Strand | | GCUGCUUGCUAAUGACGUUAUCCAGGG | 694 |
| STAT3-1008 | 27 mer Antisense Strand | | GCUGCUUCUGCUAAUGACGUUAUCCGG | 695 |
| STAT3-1009 | 27 mer Antisense Strand | | GCUGCUUUCUGCUAAUGACGUUAUCGG | 696 |
| STAT3-1010 | 27 mer Antisense Strand | | GCUGCUAUUCUGCUAAUGACGUUAUGG | 697 |
| STAT3-1047 | 27 mer Antisense Strand | | GCUGCUUCCAGUUUCUUAAUUUGUUGG | 698 |
| STAT3-1067 | 27 mer Antisense Strand | | GCUGCUAAACUUUUUGCUGCAACUCGG | 699 |
| STAT3-1068 | 27 mer Antisense Strand | | GCUGCUGAAACUUUUUGCUGCAACUGG | 700 |
| STAT3-1145 | 27 mer Antisense Strand | | GCUGCUUCAUUAAGUUUCUAAACAGGG | 70 |
| STAT3-1151 | 27 mer Antisense Strand | | GCUGCUCACUUUUCAUUAAGUUUCUGG | 702 |
| STAT3-1241 | 27 mer Antisense Strand | | GCUGCUUGACUUUAGUAGUGAACUGGG | 703 |
| STAT3-1268 | 27 mer Antisense Strand | | GCUGCUUCAACUCAGGGAAUUUGACGG | 704 |
| STAT3-1272 | 27 mer Antisense Strand | | GCUGCUUAAUUCAACUCAGGGAAUUGG | 705 |

-continued

SEQUENCE LISTING

| Name | Description | Species | Sequence | SEQ ID NO |
|---|---|---|---|---|
| STAT3-1273 | 27 mer Antisense Strand | | GCUGCUAUAAUUCAACUCAGGGAAUGG | 706 |
| STAT3-1275 | 27 mer Antisense Strand | | GCUGCUUGAUAAUUCAACUCAGGGAGG | 707 |
| STAT3-1277 | 27 mer Antisense Strand | | GCUGCUGCUGAUAAUUCAACUCAGGGG | 708 |
| STAT3-1278 | 27 mer Antisense Strand | | GCUGCUAGCUGAUAAUUCAACUCAGGG | 709 |
| STAT3-1279 | 27 mer Antisense Strand | | GCUGCUAAGCUGAUAAUUCAACUCAGG | 710 |
| STAT3-1280 | 27 mer Antisense Strand | | GCUGCUUAAGCUGAUAAUUCAACUCGG | 711 |
| STAT3-1281 | 27 mer Antisense Strand | | GCUGCUUUAAGCUGAUAAUUCAACUGG | 712 |
| STAT3-1282 | 27 mer Antisense Strand | | GCUGCUUUUAAGCUGAUAAUUCAACGG | 713 |
| STAT3-1283 | 27 mer Antisense Strand | | GCUGCUUUUUAAGCUGAUAAUUCAAGG | 714 |
| STAT3-1284 | 27 mer Antisense Strand | | GCUGCUAUUUUAAGCUGAUAAUUCAGG | 715 |
| STAT3-1286 | 27 mer Antisense Strand | | GCUGCUUAAUUUUAAGCUGAUAAUUGG | 716 |
| STAT3-1287 | 27 mer Antisense Strand | | GCUGCUUUAAUUUUAAGCUGAUAAUGG | 717 |
| STAT3-1292 | 27 mer Antisense Strand | | GCUGCUACACUUUAAUUUUAAGCUGGG | 718 |
| STAT3-1293 | 27 mer Antisense Strand | | GCUGCUCACACUUUAAUUUUAAGCUGG | 719 |
| STAT3-1299 | 27 mer Antisense Strand | | GCUGCUUCAAUGCACACUUUAAUUUGG | 720 |
| STAT3-1305 | 27 mer Antisense Strand | | GCUGCUUCUUUGUCAAUGCACACUUGG | 721 |
| STAT3-1383 | 27 mer Antisense Strand | | GCUGCUUCCAUGUUCAUCACUUUUGGG | 722 |
| STAT3-1388 | 27 mer Antisense Strand | | GCUGCUAUUCUUCCAUGUUCAUCACGG | 723 |
| STAT3-1427 | 27 mer Antisense Strand | | GCUGCUUCAAGUGUUUGAAUUCUGCGG | 724 |
| STAT3-1485 | 27 mer Antisense Strand | | GCUGCUAUCAGGGAAGCAUCACAAUGG | 725 |
| STAT3-1584 | 27 mer Antisense Strand | | GCUGCUAUCACCACAACUGGCAAGGGG | 726 |
| STAT3-1586 | 27 mer Antisense Strand | | GCUGCUAGAUCACCACAACUGGCAAGG | 727 |
| STAT3-1670 | 27 mer Antisense Strand | | GCUGCUAAAAGUUUACAUUCUUGGGGG | 728 |
| STAT3-1671 | 27 mer Antisense Strand | | GCUGCUAAAAAGUUUACAUUCUUGGGG | 729 |

-continued

SEQUENCE LISTING

| Name | Description | Species | Sequence | SEQ ID NO |
| --- | --- | --- | --- | --- |
| STAT3-1672 | 27 mer Antisense Strand | | GCUGCUAAAAAAGUUUACAUUCUUGGG | 730 |
| STAT3-1673 | 27 mer Antisense Strand | | GCUGCUUAAAAAAGUUUACAUUCUUGG | 731 |
| STAT3-1674 | 27 mer Antisense Strand | | GCUGCUGUAAAAAAGUUUACAUUCUGG | 732 |
| STAT3-1676 | 27 mer Antisense Strand | | GCUGCUUGGUAAAAAAGUUUACAUUGG | 733 |
| STAT3-1813 | 27 mer Antisense Strand | | GCUGCUUGAAUAAUUCACACCAGGUGG | 734 |
| STAT3-1815 | 27 mer Antisense Strand | | GCUGCUCCUGAAUAAUUCACACCAGGG | 735 |
| STAT3-1817 | 27 mer Antisense Strand | | GCUGCUACCCUGAAUAAUUCACACCGG | 736 |
| STAT3-1819 | 27 mer Antisense Strand | | GCUGCUACACCCUGAAUAAUUCACAGG | 737 |
| STAT3-1904 | 27 mer Antisense Strand | | GCUGCUGGUCAAUGAUAUUGUCCAGGG | 738 |
| STAT3-1906 | 27 mer Antisense Strand | | GCUGCUAAGGUCAAUGAUAUUGUCCGG | 739 |
| STAT3-1907 | 27 mer Antisense Strand | | GCUGCUCAAGGUCAAUGAUAUUGUCGG | 740 |
| STAT3-1908 | 27 mer Antisense Strand | | GCUGCUACAAGGUCAAUGAUAUUGUGG | 741 |
| STAT3-1909 | 27 mer Antisense Strand | | GCUGCUCACAAGGUCAAUGAUAUUGGG | 742 |
| STAT3-1910 | 27 mer Antisense Strand | | GCUGCUUCACAAGGUCAAUGAUAUUGG | 743 |
| STAT3-1911 | 27 mer Antisense Strand | | GCUGCUUUCACAAGGUCAAUGAUAUGG | 744 |
| STAT3-1912 | 27 mer Antisense Strand | | GCUGCUUUUCACAAGGUCAAUGAUAGG | 745 |
| STAT3-1913 | 27 mer Antisense Strand | | GCUGCUUUUUCACAAGGUCAAUGAUGG | 746 |
| STAT3-1914 | 27 mer Antisense Strand | | GCUGCUUUUUUCACAAGGUCAAUGAGG | 747 |
| STAT3-1916 | 27 mer Antisense Strand | | GCUGCUACUUUUUCACAAGGUCAAUGG | 748 |
| STAT3-1917 | 27 mer Antisense Strand | | GCUGCUUACUUUUUCACAAGGUCAAGG | 749 |
| STAT3-1919 | 27 mer Antisense Strand | | GCUGCUUGUACUUUUUCACAAGGUCGG | 750 |
| STAT3-1920 | 27 mer Antisense Strand | | GCUGCUAUGUACUUUUUCACAAGGUGG | 751 |
| STAT3-2024 | 27 mer Antisense Strand | | GCUGCUUGAAUCUUAGCAGGAAGGUGG | 752 |
| STAT3-2135 | 27 mer Antisense Strand | | GCUGCUUGUUGUUCAGCUGCUGCUUGG | 753 |

-continued

SEQUENCE LISTING

| Name | Description | Species | Sequence | SEQ ID NO |
|---|---|---|---|---|
| STAT3-2136 | 27 mer Antisense Strand | | GCUGCUAUGUUGUUCAGCUGCUGCUGG | 754 |
| STAT3-2138 | 27 mer Antisense Strand | | GCUGCUACAUGUUGUUCAGCUGCUGGG | 755 |
| STAT3-2139 | 27 mer Antisense Strand | | GCUGCUGACAUGUUGUUCAGCUGCUGG | 756 |
| STAT3-2143 | 27 mer Antisense Strand | | GCUGCUAAAUGACAUGUUGUUCAGCGG | 757 |
| STAT3-2144 | 27 mer Antisense Strand | | GCUGCUCAAAUGACAUGUUGUUCAGGG | 758 |
| STAT3-2145 | 27 mer Antisense Strand | | GCUGCUGCAAAUGACAUGUUGUUCAGG | 759 |
| STAT3-2146 | 27 mer Antisense Strand | | GCUGCUAGCAAAUGACAUGUUGUUCGG | 760 |
| STAT3-2147 | 27 mer Antisense Strand | | GCUGCUCAGCAAAUGACAUGUUGUUGG | 761 |
| STAT3-2148 | 27 mer Antisense Strand | | GCUGCUUCAGCAAAUGACAUGUUGUGG | 762 |
| STAT3-2151 | 27 mer Antisense Strand | | GCUGCUAUUUCAGCAAAUGACAUGUGG | 763 |
| STAT3-2153 | 27 mer Antisense Strand | | GCUGCUUGAUUUCAGCAAAUGACAUGG | 764 |
| STAT3-2154 | 27 mer Antisense Strand | | GCUGCUAUGAUUUCAGCAAAUGACAGG | 765 |
| STAT3-2159 | 27 mer Antisense Strand | | GCUGCUCCAUGAUGAUUUCAGCAAAGG | 766 |
| STAT3-2322 | 27 mer Antisense Strand | | GCUGCUAACUUGGUCUUCAGGUAUGGG | 767 |
| STAT3-2325 | 27 mer Antisense Strand | | GCUGCUAUAAACUUGGUCUUCAGGUGG | 768 |
| STAT3-2327 | 27 mer Antisense Strand | | GCUGCUAGAUAAACUUGGUCUUCAGGG | 769 |
| STAT3-2329 | 27 mer Antisense Strand | | GCUGCUACAGAUAAACUUGGUCUUCGG | 770 |
| STAT3-2333 | 27 mer Antisense Strand | | GCUGCUUCACACAGAUAAACUUGGUGG | 771 |
| STAT3-2335 | 27 mer Antisense Strand | | GCUGCUUGUCACACAGAUAAACUUGGG | 772 |
| STAT3-2404 | 27 mer Antisense Strand | | GCUGCUAAACUGCAUCAAUGAAUCUGG | 773 |
| STAT3-2405 | 27 mer Antisense Strand | | GCUGCUCAAACUGCAUCAAUGAAUCGG | 774 |
| STAT3-2407 | 27 mer Antisense Strand | | GCUGCUUCCAAACUGCAUCAAUGAAGG | 775 |
| STAT3-2408 | 27 mer Antisense Strand | | GCUGCUUUCCAAACUGCAUCAAUGAGG | 776 |
| STAT3-2411 | 27 mer Antisense Strand | | GCUGCUUAUUUCCAAACUGCAUCAAGG | 777 |

-continued

SEQUENCE LISTING

| Name | Description | Species | Sequence | SEQ ID NO |
|---|---|---|---|---|
| STAT3-2412 | 27 mer Antisense Strand | | GCUGCUUUAUUUCCAAACUGCAUCAGG | 778 |
| STAT3-2413 | 27 mer Antisense Strand | | GCUGCUAUUAUUUCCAAACUGCAUCGG | 779 |
| STAT3-2416 | 27 mer Antisense Strand | | GCUGCUACCAUUAUUUCCAAACUGCGG | 780 |
| STAT3-2418 | 27 mer Antisense Strand | | GCUGCUUCACCAUUAUUUCCAAACUGG | 781 |
| STAT3-2422 | 27 mer Antisense Strand | | GCUGCUACCUUCACCAUUAUUUCCAGG | 782 |
| STAT3-2427 | 27 mer Antisense Strand | | GCUGCUUCAGCACCUUCACCAUUAUGG | 783 |
| STAT3-2612 | 27 mer Antisense Strand | | GCUGCUACAAAGUUAGUAGUUUCAGGG | 784 |
| STAT3-2615 | 27 mer Antisense Strand | | GCUGCUACCACAAAGUUAGUAGUUUGG | 785 |
| STAT3-2616 | 27 mer Antisense Strand | | GCUGCUAACCACAAAGUUAGUAGUUGG | 786 |
| STAT3-2617 | 27 mer Antisense Strand | | GCUGCUGAACCACAAAGUUAGUAGUGG | 787 |
| STAT3-2622 | 27 mer Antisense Strand | | GCUGCUAUCUGGAACCACAAAGUUAGG | 788 |
| STAT3-2625 | 27 mer Antisense Strand | | GCUGCUAAAAUCUGGAACCACAAAGGG | 789 |
| STAT3-2626 | 27 mer Antisense Strand | | GCUGCUAAAAAUCUGGAACCACAAAGG | 790 |
| STAT3-2627 | 27 mer Antisense Strand | | GCUGCUAAAAAAUCUGGAACCACAAGG | 791 |
| STAT3-2692 | 27 mer Antisense Strand | | GCUGCUUUCACUCAUUUCUCUAUUUGG | 792 |
| STAT3-2693 | 27 mer Antisense Strand | | GCUGCUAUUCACUCAUUUCUCUAUUGG | 793 |
| STAT3-2715 | 27 mer Antisense Strand | | GCUGCUUAGAUAAAAGCAGAUCACCGG | 794 |
| STAT3-2719 | 27 mer Antisense Strand | | GCUGCUCAUUUAGAUAAAAGCAGAUGG | 795 |
| STAT3-2721 | 27 mer Antisense Strand | | GCUGCUUGCAUUUAGAUAAAAGCAGGG | 796 |
| STAT3-2735 | 27 mer Antisense Strand | | GCUGCUAACACAUCCUUAUUUGCAUGG | 797 |
| STAT3-2741 | 27 mer Antisense Strand | | GCUGCUUCAGAGAACACAUCCUUAUGG | 798 |
| STAT3-2801 | 27 mer Antisense Strand | | GCUGCUACAAGACAUUUCCUUUUUCGG | 799 |
| STAT3-2803 | 27 mer Antisense Strand | | GCUGCUACACAAGACAUUUCCUUUUGG | 800 |
| STAT3-2804 | 27 mer Antisense Strand | | GCUGCUAACACAAGACAUUUCCUUUGG | 801 |

-continued

SEQUENCE LISTING

| Name | Description | Species | Sequence | SEQ ID NO |
|---|---|---|---|---|
| STAT3-2806 | 27 mer Antisense Strand | | GCUGCUACAACACAAGACAUUUCCUGG | 802 |
| STAT3-2807 | 27 mer Antisense Strand | | GCUGCUAACAACACAAGACAUUUCCGG | 803 |
| STAT3-2808 | 27 mer Antisense Strand | | GCUGCUAAACAACACAAGACAUUUCGG | 804 |
| STAT3-2809 | 27 mer Antisense Strand | | GCUGCUAAAACAACACAAGACAUUUGG | 805 |
| STAT3-2810 | 27 mer Antisense Strand | | GCUGCUCAAAACAACACAAGACAUUGG | 806 |
| STAT3-2811 | 27 mer Antisense Strand | | GCUGCUACAAAACAACACAAGACAUGG | 807 |
| STAT3-2812 | 27 mer Antisense Strand | | GCUGCUAACAAAACAACACAAGACAGG | 808 |
| STAT3-2813 | 27 mer Antisense Strand | | GCUGCUGAACAAAACAACACAAGACGG | 809 |
| STAT3-2846 | 27 mer Antisense Strand | | GCUGCUAUAACAAAAAGCUGCUGAGGG | 810 |
| STAT3-2848 | 27 mer Antisense Strand | | GCUGCUCAAUAACAAAAAGCUGCUGGG | 811 |
| STAT3-2849 | 27 mer Antisense Strand | | GCUGCUACAAUAACAAAAAGCUGCUGG | 812 |
| STAT3-2850 | 27 mer Antisense Strand | | GCUGCUAACAAUAACAAAAAGCUGCGG | 813 |
| STAT3-2851 | 27 mer Antisense Strand | | GCUGCUCAACAAUAACAAAAAGCUGGG | 814 |
| STAT3-2852 | 27 mer Antisense Strand | | GCUGCUACAACAAUAACAAAAAGCUGG | 815 |
| STAT3-2853 | 27 mer Antisense Strand | | GCUGCUAACAACAAUAACAAAAAGCGG | 816 |
| STAT3-2854 | 27 mer Antisense Strand | | GCUGCUCAACAACAAUAACAAAAAGGG | 817 |
| STAT3-2855 | 27 mer Antisense Strand | | GCUGCUACAACAACAAUAACAAAAAGG | 818 |
| STAT3-2856 | 27 mer Antisense Strand | | GCUGCUAACAACAACAAUAACAAAAGG | 819 |
| STAT3-2857 | 27 mer Antisense Strand | | GCUGCUCAACAACAACAAUAACAAAGG | 820 |
| STAT3-2858 | 27 mer Antisense Strand | | GCUGCUACAACAACAACAAUAACAAGG | 821 |
| STAT3-2859 | 27 mer Antisense Strand | | GCUGCUAACAACAACAACAAUAACAGG | 822 |
| STAT3-2860 | 27 mer Antisense Strand | | GCUGCUGAACAACAACAACAAUAACGG | 823 |
| STAT3-2861 | 27 mer Antisense Strand | | GCUGCUAGAACAACAACAACAAUAAGG | 824 |
| STAT3-2862 | 27 mer Antisense Strand | | GCUGCUAAGAACAACAACAACAAUAGG | 825 |

-continued

SEQUENCE LISTING

| Name | Description | Species | Sequence | SEQ ID NO |
|---|---|---|---|---|
| STAT3-2863 | 27 mer Antisense Strand | | GCUGCUUAAGAACAACAACAACAAUGG | 826 |
| STAT3-2865 | 27 mer Antisense Strand | | GCUGCUUCUAAGAACAACAACAACAGG | 827 |
| STAT3-2867 | 27 mer Antisense Strand | | GCUGCUUGUCUAAGAACAACAACAAGG | 828 |
| STAT3-2868 | 27 mer Antisense Strand | | GCUGCUUUGUCUAAGAACAACAACAGG | 829 |
| STAT3-2975 | 27 mer Antisense Strand | | GCUGCUUGUCAGCAAGGUUAAAAAGGG | 830 |
| STAT3-2979 | 27 mer Antisense Strand | | GCUGCUUGGAUGUCAGCAAGGUUAAGG | 831 |
| STAT3-2985 | 27 mer Antisense Strand | | GCUGCUUCUAUUUGGAUGUCAGCAAGG | 832 |
| STAT3-3025 | 27 mer Antisense Strand | | GCUGCUUUAAUUUAAAAAGAAACCUGG | 833 |
| STAT3-3037 | 27 mer Antisense Strand | | GCUGCUUGUUAUUAUUUCUUAAUUUGG | 834 |
| STAT3-3038 | 27 mer Antisense Strand | | GCUGCUUUGUUAUUAUUUCUUAAUUGG | 835 |
| STAT3-3039 | 27 mer Antisense Strand | | GCUGCUAUUGUUAUUAUUUCUUAAUGG | 836 |
| STAT3-3041 | 27 mer Antisense Strand | | GCUGCUUAAUUGUUAUUAUUUCUUAGG | 837 |
| STAT3-3042 | 27 mer Antisense Strand | | GCUGCUUUAAUUGUUAUUAUUUCUUGG | 838 |
| STAT3-3043 | 27 mer Antisense Strand | | GCUGCUUUUAAUUGUUAUUAUUUCUGG | 839 |
| STAT3-3225 | 27 mer Antisense Strand | | GCUGCUAAUUUUUUGUACUUUUAGUGG | 840 |
| STAT3-3226 | 27 mer Antisense Strand | | GCUGCUUAAUUUUUUGUACUUUUAGGG | 841 |
| STAT3-3605 | 27 mer Antisense Strand | | GCUGCUUACAAAGGAAAAUAAGUCUGG | 842 |
| STAT3-3611 | 27 mer Antisense Strand | | GCUGCUAUACAUUACAAAGGAAAAUGG | 843 |
| STAT3-3906 | 27 mer Antisense Strand | | GCUGCUUCAUGUCCAACCUGUAACUGG | 844 |
| STAT3-4311 | 27 mer Antisense Strand | | GCUGCUUAACAAACAGAAUUCCACAGG | 845 |
| STAT3-4314 | 27 mer Antisense Strand | | GCUGCUAUUUAACAAACAGAAUUCCGG | 846 |
| STAT3-4317 | 27 mer Antisense Strand | | GCUGCUUUGAUUUAACAAACAGAAUGG | 847 |
| STAT3-4321 | 27 mer Antisense Strand | | GCUGCUUAAUUUGAUUUAACAAACAGG | 848 |
| STAT3-4465 | 27 mer Antisense Strand | | GCUGCUUCAGUUAAGCUUAUUAUGUGG | 849 |

-continued

SEQUENCE LISTING

| Name | Description | Species | Sequence | SEQ ID NO |
|---|---|---|---|---|
| STAT3-4479 | 27 mer Antisense Strand | | GCUGCUAAAUAUUCUGUUUAUCAGUGG | 850 |
| STAT3-4480 | 27 mer Antisense Strand | | GCUGCUUAAAUAUUCUGUUUAUCAGGG | 851 |
| STAT3-4831 | 27 mer Antisense Strand | | GCUGCUAAUAUAAAUUUUUACACUAGG | 852 |
| STAT3-4833 | 27 mer Antisense Strand | | GCUGCUAUAAUAUAAAUUUUUACACGG | 853 |
| STAT3-4836 | 27 mer Antisense Strand | | GCUGCUACAAUAAUAUAAAUUUUUAGG | 854 |
| STAT3-4837 | 27 mer Antisense Strand | | GCUGCUCACAAUAAUAUAAAUUUUUGG | 855 |
| STAT3-4909 | 27 mer Antisense Strand | | GCUGCUUUUAUUUCUGGAAGUUAAAGG | 856 |
| STAT3-715 | UnModified 36 mer | | CCAGGAUGACUUUGAUUUCAGCAGCCGAAAGGCUGC | 857 |
| STAT3-716 | UnModified 36 mer | | CAGGAUGACUUUGAUUUCAAGCAGCCGAAAGGCUGC | 858 |
| STAT3-717 | UnModified 36 mer | | AGGAUGACUUUGAUUUCAAAGCAGCCGAAAGGCUGC | 859 |
| STAT3-720 | UnModified 36 mer | | AUGACUUUGAUUUCAACUAAGCAGCCGAAAGGCUGC | 860 |
| STAT3-372 | UnModified 36 mer | | CUUUGGUGUUUCAUAAUCUAGCAGCCGAAAGGCUGC | 861 |
| STAT3-721 | UnModified 36 mer | | UGACUUUGAUUUCAACUAUAGCAGCCGAAAGGCUGC | 862 |
| STAT3-722 | UnModified 36 mer | | GACUUUGAUUUCAACUAUAAGCAGCCGAAAGGCUGC | 863 |
| STAT3-768 | UnModified 36 mer | | AAGAUCUGAAUGGAAACAAAGCAGCCGAAAGGCUGC | 864 |
| STAT3-1001 | UnModified 36 mer | | GAAAACUGGAUAACGUCAUAGCAGCCGAAAGGCUGC | 865 |
| STAT3-1006 | UnModified 36 mer | | CUGGAUAACGUCAUUAGCAAGCAGCCGAAAGGCUGC | 866 |
| STAT3-1145 | UnModified 36 mer | | CUGUUUAGAAACUUAAUGAAGCAGCCGAAAGGCUGC | 867 |
| STAT3-1151 | UnModified 36 mer | | AGAAACUUAAUGAAAAGUGAGCAGCCGAAAGGCUGC | 868 |
| STAT3-1268 | UnModified 36 mer | | GUCAAAUUCCCUGAGUUGAAGCAGCCGAAAGGCUGC | 869 |
| STAT3-1273 | UnModified 36 mer | | AUUCCCUGAGUUGAAUUAUAGCAGCCGAAAGGCUGC | 870 |
| STAT3-1279 | UnModified 36 mer | | UGAGUUGAAUUAUCAGCUUAGCAGCCGAAAGGCUGC | 871 |
| STAT3-1280 | UnModified 36 mer | | GAGUUGAAUUAUCAGCUUAAGCAGCCGAAAGGCUGC | 872 |
| STAT3-1281 | UnModified 36 mer | | GAGUUGAAUUAUCAGCUUAAGCAGCCGAAAGGCUGC | 873 |
| STAT3-1284 | UnModified 36 mer | | UGAAUUAUCAGCUUAAAAUAGCAGCCGAAAGGCUGC | 874 |

-continued

SEQUENCE LISTING

| Name | Description | Species | Sequence | SEQ ID NO |
|---|---|---|---|---|
| STAT3-1286 | UnModified 36 mer | | AAUUAUCAGCUUAAAAUUAAGCAGCCGAAAGGCUGC | 875 |
| STAT3-1287 | UnModified 36 mer | | AUUAUCAGCUUAAAAUUAAAGCAGCCGAAAGGCUGC | 876 |
| STAT3-1292 | UnModified 36 mer | | CAGCUUAAAAUUAAAGUGUAGCAGCCGAAAGGCUGC | 877 |
| STAT3-1293 | UnModified 36 mer | | AGCUUAAAAUUAAAGUGUGAGCAGCCGAAAGGCUGC | 878 |
| STAT3-1819 | UnModified 36 mer | | UGUGAAUUAUUCAGGGUGUAGCAGCCGAAAGGCUGC | 879 |
| STAT3-1908 | UnModified 36 mer | | ACAAUAUCAUUGACCUUGUAGCAGCCGAAAGGCUGC | 880 |
| STAT3-1910 | UnModified 36 mer | | AAUAUCAUUGACCUUGUGAAGCAGCCGAAAGGCUGC | 881 |
| STAT3-1913 | UnModified 36 mer | | AUCAUUGACCUUGUGAAAAAGCAGCCGAAAGGCUGC | 882 |
| STAT3-2154 | UnModified 36 mer | | UGUCAUUUGCUGAAAUCAUAGCAGCCGAAAGGCUGC | 883 |
| STAT3-2327 | UnModified 36 mer | | CUGAAGACCAAGUUUAUCUAGCAGCCGAAAGGCUGC | 884 |
| STAT3-2335 | UnModified 36 mer | | CAAGUUUAUCUGUGUGACAAGCAGCCGAAAGGCUGC | 885 |
| STAT3-2418 | UnModified 36 mer | | AGUUUGGAAAUAAUGGUGAAGCAGCCGAAAGGCUGC | 886 |
| STAT3-2692 | UnModified 36 mer | | AAAUAGAGAAAUGAGUGAAAGCAGCCGAAAGGCUGC | 887 |
| STAT3-2693 | UnModified 36 mer | | AAUAGAGAAAUGAGUGAAUAGCAGCCGAAAGGCUGC | 888 |
| STAT3-2627 | UnModified 36 mer | Hs-Mf-Mm | UUGUGGUUCCAGAUUUUUUAGCAGCCGAAAGGCUGC | 889 |
| STAT3-2626 | UnModified 36 mer | Hs-Mf-Mm | UUUGUGGUUCCAGAUUUUUAGCAGCCGAAAGGCUGC | 890 |
| STAT3-2407 | UnModified 36 mer | Hs-Mf-Mm | UUCAUUGAUGCAGUUUGGAAGCAGCCGAAAGGCUGC | 891 |
| STAT3-2412 | UnModified 36 mer | Hs-Mf-Mm | UGAUGCAGUUUGGAAAUAAAGCAGCCGAAAGGCUGC | 892 |
| STAT3-2151 | UnModified 36 mer | Hs-Mf-Mm | ACAUGUCAUUUGCUGAAAUAGCAGCCGAAAGGCUGC | 893 |
| STAT3-2625 | UnModified 36 mer | Hs-Mf-Mm | CUUUGUGGUUCCAGAUUUUAGCAGCCGAAAGGCUGC | 894 |
| STAT3-4836 | UnModified 36 mer | Hs-Mf-Mm | UAAAAAUUUAUAUUAUUGUAGCAGCCGAAAGGCUGC | 895 |
| STAT3-2408 | UnModified 36 mer | Hs-Mf-Mm | UCAUUGAUGCAGUUUGGAAAGCAGCCGAAAGGCUGC | 896 |
| STAT3-2159 | UnModified 36 mer | Hs-Mf-Mm | UUUGCUGAAAUCAUCAUGGAGCAGCCGAAAGGCUGC | 897 |
| STAT3-2146 | UnModified 36 mer | Hs-Mf-Mm | GAACAACAUGUCAUUUGCUAGCAGCCGAAAGGCUGC | 898 |

-continued

SEQUENCE LISTING

| Name | Description | Species | Sequence | SEQ ID NO |
|---|---|---|---|---|
| STAT3-2148 | UnModified 36 mer | Hs-Mf-Mm | ACAACAUGUCAUUUGCUGAAGCAGCCGAAAGGCUGC | 899 |
| STAT3-2147 | UnModified 36 mer | Hs-Mf-Mm | AACAACAUGUCAUUUGCUGAGCAGCCGAAAGGCUGC | 900 |
| STAT3-0461 | UnModified 36 mer | Hs-Mf-Mm | CGAAGAAUCAAGCAGUUUCAGCAGCCGAAAGGCUGC | 901 |
| STAT3-1584 | UnModified 36 mer | Hs-Mf-Mm | CCUUGCCAGUUGUGGUGAUAGCAGCCGAAAGGCUGC | 902 |
| STAT3-1047 | UnModified 36 mer | Hs-Mf-Mm | AACAAAUUAAGAAACUGGAAGCAGCCGAAAGGCUGC | 903 |
| STAT3-0773 | UnModified 36 mer | Hs-Mf-Mm | CUGAAUGGAAACAACCAGUAGCAGCCGAAAGGCUGC | 904 |
| STAT3-0492 | UnModified 36 mer | Hs-Mf-Mm | AUCUUGAGAAGCCAAUGGAAGCAGCCGAAAGGCUGC | 905 |
| STAT3-0462 | UnModified 36 mer | Hs-Mf-Mm | GAAGAAUCAAGCAGUUUCUAGCAGCCGAAAGGCUGC | 906 |
| STAT3-1586 | UnModified 36 mer | Hs-Mf-Mm | UUGCCAGUUGUGGUGAUCUAGCAGCCGAAAGGCUGC | 907 |
| STAT3-0771 | UnModified 36 mer | Hs-Mf-Mm | AUCUGAAUGGAAACAACCAAGCAGCCGAAAGGCUGC | 908 |
| STAT3-0681 | UnModified 36 mer | Hs-Mf-Mm | AUCUAGAACAGAAAAUGAAAGCAGCCGAAAGGCUGC | 909 |
| STAT3-0678 | UnModified 36 mer | Hs-Mf-Mm | AGGAUCUAGAACAGAAAAUAGCAGCCGAAAGGCUGC | 910 |
| STAT3-4837 | UnModified 36 mer | Hs-Mf-Mm | AAAAAUUUAUAUUAUUGUGAGCAGCCGAAAGGCUGC | 911 |
| STAT3-4833 | UnModified 36 mer | Hs-Mf-Mm | GUGUAAAAAUUUAUAUUAUAGCAGCCGAAAGGCUGC | 912 |
| STAT3-1068 | UnModified 36 mer | Hs | AGUUGCAGCAAAAAGUUUCAGCAGCCGAAAGGCUGC | 913 |
| STAT3-1673 | UnModified 36 mer | Hs | AAGAAUGUAAACUUUUUUAAGCAGCCGAAAGGCUGC | 914 |
| STAT3-0426 | UnModified 36 mer | Hs | UGCAAGAGUCGAAUGUUCUAGCAGCCGAAAGGCUGC | 915 |
| STAT3-2404 | UnModified 36 mer | Hs | AGAUUCAUUGAUGCAGUUUAGCAGCCGAAAGGCUGC | 916 |
| STAT3-1067 | UnModified 36 mer | Hs | GAGUUGCAGCAAAAAGUUUAGCAGCCGAAAGGCUGC | 917 |
| STAT3-0433 | UnModified 36 mer | Hs | GUCGAAUGUUCUCUAUCAGAGCAGCCGAAAGGCUGC | 918 |
| STAT3-1670 | UnModified 36 mer | Hs | CCCAAGAAUGUAAACUUUUAGCAGCCGAAAGGCUGC | 919 |
| STAT3-1388 | UnModified 36 mer | Hs | GUGAUGAACAUGGAAGAAUAGCAGCCGAAAGGCUGC | 920 |
| STAT3-0429 | UnModified 36 mer | Hs | AAGAGUCGAAUGUUCUCUAAGCAGCCGAAAGGCUGC | 921 |
| STAT3-2405 | UnModified 36 mer | Hs | GAUUCAUUGAUGCAGUUUGAGCAGCCGAAAGGCUGC | 922 |

-continued

SEQUENCE LISTING

| Name | Description | Species | Sequence | SEQ ID NO |
|---|---|---|---|---|
| STAT3-0430 | UnModified 36 mer | Hs | AGAGUCGAAUGUUCUCUAUAGCAGCCGAAAGGCUGC | 923 |
| STAT3-0432 | UnModified 36 mer | Hs | AGUCGAAUGUUCUCUAUCAAGCAGCCGAAAGGCUGC | 924 |
| STAT3-1815 | UnModified 36 mer | Hs | CUGGUGUGAAUUAUUCAGGAGCAGCCGAAAGGCUGC | 925 |
| STAT3-0424 | UnModified 36 mer | Hs | CCUGCAAGAGUCGAAUGUUAGCAGCCGAAAGGCUGC | 926 |
| STAT3-2024 | UnModified 36 mer | Hs | ACCUUCCUGCUAAGAUUCAAGCAGCCGAAAGGCUGC | 927 |
| STAT3-1813 | UnModified 36 mer | Hs | ACCUGGUGUGAAUUAUUCAAGCAGCCGAAAGGCUGC | 928 |
| STAT3-1674 | UnModified 36 mer | Hs | AGAAUGUAAACUUUUUUACAGCAGCCGAAAGGCUGC | 929 |
| STAT3-1241 | UnModified 36 mer | Hs | CAGUUCACUACUAAAGUCAAGCAGCCGAAAGGCUGC | 930 |
| STAT3-1672 | UnModified 36 mer | Hs | CAAGAAUGUAAACUUUUUUAGCAGCCGAAAGGCUGC | 931 |
| STAT3-0425 | UnModified 36 mer | Hs | CUGCAAGAGUCGAAUGUUCAGCAGCCGAAAGGCUGC | 932 |
| STAT3-1817 | UnModified 36 mer | Hs | GGUGUGAAUUAUUCAGGGUAGCAGCCGAAAGGCUGC | 933 |
| STAT3-1671 | UnModified 36 mer | Hs | CCAAGAAUGUAAACUUUUUAGCAGCCGAAAGGCUGC | 934 |
| STAT3-2136 | UnModified 36 mer | Hs-Mm | AGCAGCAGCUGAACAACAUAGCAGCCGAAAGGCUGC | 935 |
| STAT3-2143 | UnModified 36 mer | Hs-Mm | GCUGAACAACAUGUCAUUUAGCAGCCGAAAGGCUGC | 936 |
| STAT3-2144 | UnModified 36 mer | Hs-Mm | CUGAACAACAUGUCAUUUGAGCAGCCGAAAGGCUGC | 937 |
| STAT3-2138 | UnModified 36 mer | Hs-Mm | CAGCAGCUGAACAACAUGUAGCAGCCGAAAGGCUGC | 938 |
| STAT3-4909 | UnModified 36 mer | Hs-Mm | UUUAACUUCCAGAAAUAAAAGCAGCCGAAAGGCUGC | 939 |
| STAT3-2139 | UnModified 36 mer | Hs-Mm | AGCAGCUGAACAACAUGUCAGCAGCCGAAAGGCUGC | 940 |
| STAT3-2411 | UnModified 36 mer | Hs-Mm | UUGAUGCAGUUUGGAAAUAAGCAGCCGAAAGGCUGC | 941 |
| STAT3-2145 | UnModified 36 mer | Hs-Mm | UGAACAACAUGUCAUUUGCAGCAGCCGAAAGGCUGC | 942 |
| STAT3-4831 | UnModified 36 mer | Hs-Mm | UAGUGUAAAAAUUUAUAUUAGCAGCCGAAAGGCUGC | 943 |
| STAT3-2622 | UnModified 36 mer | Hs-Mm | UAACUUUGUGGUUCCAGAUAGCAGCCGAAAGGCUGC | 944 |
| STAT3-2135 | UnModified 36 mer | Hs-Mm | AAGCAGCAGCUGAACAACAAGCAGCCGAAAGGCUGC | 945 |
| STAT3-1383 | UnModified 36 mer | Hs-Mm | CAAAAGUGAUGAACAUGGAAGCAGCCGAAAGGCUGC | 946 |

-continued

| SEQUENCE LISTING | | | | |
|---|---|---|---|---|
| Name | Description | Species | Sequence | SEQ ID NO |
| STAT3-715 | UnModified 22 mer | | UGAAAUCAAAGUCAUCCUGGGG | 947 |
| STAT3-716 | UnModified 22 mer | | UUGAAAUCAAAGUCAUCCUGGG | 948 |
| STAT3-717 | UnModified 22 mer | | UUUGAAAUCAAAGUCAUCCUGG | 949 |
| STAT3-720 | UnModified 22 mer | | UUAGUUGAAAUCAAAGUCAUGG | 950 |
| STAT3-372 | UnModified 22 mer | | UAGAUUAUGAAACACCAAAGGG | 951 |
| STAT3-721 | UnModified 22 mer | | UAUAGUUGAAAUCAAAGUCAGG | 952 |
| STAT3-722 | UnModified 22 mer | | UUAUAGUUGAAAUCAAAGUCGG | 953 |
| STAT3-768 | UnModified 22 mer | | UUUGUUUCCAUUCAGAUCUUGG | 954 |
| STAT3-1001 | UnModified 22 mer | | UAUGACGUUAUCCAGUUUUCGG | 955 |
| STAT3-1006 | UnModified 22 mer | | UUGCUAAUGACGUUAUCCAGGG | 956 |
| STAT3-1145 | UnModified 22 mer | | UUCAUUAAGUUUCUAAACAGGG | 957 |
| STAT3-1151 | UnModified 22 mer | | UCACUUUUCAUUAAGUUUCUGG | 958 |
| STAT3-1268 | UnModified 22 mer | | UUCAACUCAGGGAAUUUGACGG | 959 |
| STAT3-1273 | UnModified 22 mer | | UAUAAUUCAACUCAGGGAAUGG | 960 |
| STAT3-1279 | UnModified 22 mer | | UAAGCUGAUAAUUCAACUCAGG | 961 |
| STAT3-1280 | UnModified 22 mer | | UUAAGCUGAUAAUUCAACUCGG | 962 |
| STAT3-1281 | UnModified 22 mer | | UUUAAGCUGAUAAUUCAACUGG | 963 |
| STAT3-1284 | UnModified 22 mer | | UAUUUUAAGCUGAUAAUUCAGG | 964 |
| STAT3-1286 | UnModified 22 mer | | UUAAUUUUAAGCUGAUAAUUGG | 965 |
| STAT3-1287 | UnModified 22 mer | | UUUAAUUUUAAGCUGAUAAUGG | 966 |
| STAT3-1292 | UnModified 22 mer | | UACACUUUAAUUUUAAGCUGGG | 967 |
| STAT3-1293 | UnModified 22 mer | | UCACACUUUAAUUUUAAGCUGG | 968 |
| STAT3-1819 | UnModified 22 mer | | UACACCCUGAAUAAUUCACAGG | 969 |
| STAT3-1908 | UnModified 22 mer | | UACAAGGUCAAUGAUAUUGUGG | 970 |
| STAT3-1910 | UnModified 22 mer | | UUCACAAGGUCAAUGAUAUUGG | 971 |
| STAT3-1913 | UnModified 22 mer | | UUUUUCACAAGGUCAAUGAUGG | 972 |
| STAT3-2154 | UnModified 22 mer | | UAUGAUUUCAGCAAAUGACAGG | 973 |
| STAT3-2327 | UnModified 22 mer | | UAGAUAAACUUGGUCUUCAGGG | 974 |
| STAT3-2335 | UnModified 22 mer | | UUGUCACACAGAUAAACUUGGG | 975 |
| STAT3-2418 | UnModified 22 mer | | UUCACCAUUAUUUCCAAACUGG | 976 |
| STAT3-2692 | UnModified 22 mer | | UUUCACUCAUUUCUCUAUUUGG | 977 |
| STAT3-2693 | UnModified 22 mer | | UAUUCACUCAUUUCUCUAUUGG | 978 |
| STAT3-2627 | UnModified 22 mer | Hs-Mf-Mm | UAAAAAAUCUGGAACCACAAGG | 979 |
| STAT3-2626 | UnModified 22 mer | Hs-Mf-Mm | UAAAAAUCUGGAACCACAAAGG | 980 |
| STAT3-2407 | UnModified 22 mer | Hs-Mf-Mm | UUCCAAACUGCAUCAAUGAAGG | 981 |
| STAT3-2412 | UnModified 22 mer | Hs-Mf-Mm | UUUAUUUCCAAACUGCAUCAGG | 982 |
| STAT3-2151 | UnModified 22 mer | Hs-Mf-Mm | UAUUUCAGCAAAUGACAUGUGG | 983 |

-continued

SEQUENCE LISTING

| Name | Description | Species | Sequence | SEQ ID NO |
|---|---|---|---|---|
| STAT3-2625 | UnModified 22 mer | Hs-Mf-Mm | UAAAAUCUGGAACCACAAAGGG | 984 |
| STAT3-4836 | UnModified 22 mer | Hs-Mf-Mm | UACAAUAAUAUAAAUUUUUAGG | 985 |
| STAT3-2408 | UnModified 22 mer | Hs-Mf-Mm | UUUCCAAACUGCAUCAAUGAGG | 986 |
| STAT3-2159 | UnModified 22 mer | Hs-Mf-Mm | UCCAUGAUGAUUUCAGCAAAGG | 987 |
| STAT3-2146 | UnModified 22 mer | Hs-Mf-Mm | UAGCAAAUGACAUGUUGUUCGG | 988 |
| STAT3-2148 | UnModified 22 mer | Hs-Mf-Mm | UUCAGCAAAUGACAUGUUGUGG | 989 |
| STAT3-2147 | UnModified 22 mer | Hs-Mf-Mm | UCAGCAAAUGACAUGUUGUUGG | 990 |
| STAT3-0461 | UnModified 22 mer | Hs-Mf-Mm | UGAAACUGCUUGAUUCUUCGGG | 991 |
| STAT3-1584 | UnModified 22 mer | Hs-Mf-Mm | UAUCACCACAACUGGCAAGGGG | 992 |
| STAT3-1047 | UnModified 22 mer | Hs-Mf-Mm | UUCCAGUUUCUUAAUUUGUUGG | 993 |
| STAT3-0773 | UnModified 22 mer | Hs-Mf-Mm | UACUGGUUGUUUCCAUUCAGGG | 994 |
| STAT3-0492 | UnModified 22 mer | Hs-Mf-Mm | UUCCAUUGGCUUCUCAAGAUGG | 995 |
| STAT3-0462 | UnModified 22 mer | Hs-Mf-Mm | UAGAAACUGCUUGAUUCUUCGG | 996 |
| STAT3-1586 | UnModified 22 mer | Hs-Mf-Mm | UAGAUCACCACAACUGGCAAGG | 997 |
| STAT3-0771 | UnModified 22 mer | Hs-Mf-Mm | UUGGUUGUUUCCAUUCAGAUGG | 998 |
| STAT3-0681 | UnModified 22 mer | Hs-Mf-Mm | UUUCAUUUUCUGUUCUAGAUGG | 999 |
| STAT3-0678 | UnModified 22 mer | Hs-Mf-Mm | UAUUUUCUGUUCUAGAUCCUGG | 1000 |
| STAT3-4837 | UnModified 22 mer | Hs-Mf-Mm | UCACAAUAAUAUAAAUUUUUGG | 1001 |
| STAT3-4833 | UnModified 22 mer | Hs-Mf-Mm | UAUAAUAUAAAUUUUUACACGG | 1002 |
| STAT3-1068 | UnModified 22 mer | Hs | UGAAACUUUUUGCUGCAACUGG | 1003 |
| STAT3-1673 | UnModified 22 mer | Hs | UUAAAAAAGUUUACAUUCUUGG | 1004 |
| STAT3-0426 | UnModified 22 mer | Hs | UAGAACAUUCGACUCUUGCAGG | 1005 |
| STAT3-2404 | UnModified 22 mer | Hs | UAAACUGCAUCAAUGAAUCUGG | 1006 |
| STAT3-1067 | UnModified 22 mer | Hs | UAAACUUUUUGCUGCAACUCGG | 1007 |
| STAT3-0433 | UnModified 22 mer | Hs | UCUGAUAGAGAACAUUCGACGG | 1008 |
| STAT3-1670 | UnModified 22 mer | Hs | UAAAAGUUUACAUUCUUGGGGG | 1009 |
| STAT3-1388 | UnModified 22 mer | Hs | UAUUCUUCCAUGUUCAUCACGG | 1010 |
| STAT3-0429 | UnModified 22 mer | Hs | UUAGAGAACAUUCGACUCUUGG | 1011 |
| STAT3-2405 | UnModified 22 mer | Hs | UCAAACUGCAUCAAUGAAUCGG | 1012 |
| STAT3-0430 | UnModified 22 mer | Hs | UAUAGAGAACAUUCGACUCUGG | 1013 |
| STAT3-0432 | UnModified 22 mer | Hs | UUGAUAGAGAACAUUCGACUGG | 1014 |
| STAT3-1815 | UnModified 22 mer | Hs | UCCUGAAUAAUUCACACCAGGG | 1015 |
| STAT3-0424 | UnModified 22 mer | Hs | UAACAUUCGACUCUUGCAGGGG | 1016 |
| STAT3-2024 | UnModified 22 mer | Hs | UUGAAUCUUAGCAGGAAGGUGG | 1017 |
| STAT3-1813 | UnModified 22 mer | Hs | UUGAAUAAUUCACACCAGGUGG | 1018 |
| STAT3-1674 | UnModified 22 mer | Hs | UGUAAAAAAGUUUACAUUCUGG | 1019 |

-continued

SEQUENCE LISTING

| Name | Description | Species | Sequence | SEQ ID NO |
|---|---|---|---|---|
| STAT3-1241 | UnModified 22 mer | Hs | UUGACUUUAGUAGUGAACUGGG | 1020 |
| STAT3-1672 | UnModified 22 mer | Hs | UAAAAAAGUUUACAUUCUUGGG | 1021 |
| STAT3-0425 | UnModified 22 mer | Hs | UGAACAUUCGACUCUUGCAGGG | 1022 |
| STAT3-1817 | UnModified 22 mer | Hs | UACCCUGAAUAAUUCACACCGG | 1023 |
| STAT3-1671 | UnModified 22 mer | Hs | UAAAAAGUUUACAUUCUUGGGG | 1024 |
| STAT3-2136 | UnModified 22 mer | Hs-Mm | UAUGUUGUUCAGCUGCUGCUGG | 1025 |
| STAT3-2143 | UnModified 22 mer | Hs-Mm | UAAAUGACAUGUUGUUCAGCGG | 1026 |
| STAT3-2144 | UnModified 22 mer | Hs-Mm | UCAAAUGACAUGUUGUUCAGGG | 1027 |
| STAT3-2138 | UnModified 22 mer | Hs-Mm | UACAUGUUGUUCAGCUGCUGGG | 1028 |
| STAT3-4909 | UnModified 22 mer | Hs-Mm | UUUUAUUUCUGGAAGUUAAAGG | 1029 |
| STAT3-2139 | UnModified 22 mer | Hs-Mm | UGACAUGUUGUUCAGCUGCUGG | 1030 |
| STAT3-2411 | UnModified 22 mer | Hs-Mm | UUAUUUCCAAACUGCAUCAAGG | 1031 |
| STAT3-2145 | UnModified 22 mer | Hs-Mm | UGCAAAUGACAUGUUGUUCAGG | 1032 |
| STAT3-4831 | UnModified 22 mer | Hs-Mm | UAAUAUAAAUUUUUACACUAGG | 1033 |
| STAT3-2622 | UnModified 22 mer | Hs-Mm | UAUCUGGAACCACAAAGUUAGG | 1034 |
| STAT3-2135 | UnModified 22 mer | Hs-Mm | UUGUUGUUCAGCUGCUGCUUGG | 1035 |
| STAT3-1383 | UnModified 22 mer | Hs-Mm | UUCCAUGUUCAUCACUUUUGGG | 1036 |
| STAT3-715 | Modified 36 mer | | [mCs][mC][mA][mG][mG][mA][mU][fG][fA][fC ][fU][mU][mU][mG][mA][mU][mU][mC][mA ][mG][mC][mA][mG][mC][mC][mG][ademA-GalN Ac][ademA-GalNAc][ademA-GalNAc][mG][mG][ mC][mU][mG][mC] | 1037 |
| STAT3-716 | Modified 36 mer | | [mCs][mA][mG][mG][mA][mU][mG][fA][fC][fU ][fU][mU][mG][mA][mU][mU][mC][mA][mA ][mG][mC][mA][mG][mC][mC][mG][ademA-GalN Ac][ademA-GalNAc][ademA-GalNAc][mG][mG][ mC][mU][mG][mC] | 1038 |
| STAT3-717 | Modified 36 mer | | [mAs][mG][mG][mA][mU][mG][mA][fC][fU][fU ][fU][mG][mA][mU][mU][mU][mC][mA][mA][mA ][mG][mC][mA][mG][mC][mC][mG][ademA-GalN Ac][ademA-GalNAc][ademA-GalNAc][mG][mG][ mC][mU][mG][mC] | 1039 |
| STAT3-720 | Modified 36 mer | | [mAs][mU][mG][mA][mC][mU][mU][fU][fG][fA ][fU][mU][mU][mC][mA][mA][mC][mU][mA][mA ][mG][mC][mA][mG][mC][mC][mG][ademA-GalN Ac][ademA-GalNAc][ademA-GalNAc][mG][mG][ mC][mU][mG][mC] | 1040 |
| STAT3-372 | Modified 36 mer | | [mAs][mU][mU][mU][mG][mG][mU][fG][fU][fU ][fU][mC][mA][mU][mA][mA][mU][mC][mU][mA ][mG][mC][mA][mG][mC][mC][mG][ademA-GalN Ac][ademA-GalNAc][ademA-GalNAc][mG][mG][ mC][mU][mG][mC] | 1041 |
| STAT3-721 | Modified 36 mer | | [mUs][mG][mA][mC][mU][mU][mU][fG][fA][fU ][fU][mU][mC][mA][mA][mC][mU][mA][mU][mA ][mG][mC][mA][mG][mC][mC][mG][ademA-GalN Ac][ademA-GalNAc][ademA-GalNAc][mG][mG][ mC][mU][mG][mC] | 1042 |

-continued

SEQUENCE LISTING

| Name | Description | Species | Sequence | SEQ ID NO |
|---|---|---|---|---|
| STAT3-722 | Modified 36 mer | | [mGs][mA][mC][mU][mU][mU][mG][fA][fU][fU][fU][mC][mA][mA][mC][mU][mA][mU][mA][mA][mG][mC][mA][mG][mC][mC][mG][ademA-GalNAc][ademA-GalNAc][ademA-GalNAc][mG][mG][mC][mU][mG][mC] | 1043 |
| STAT3-768 | Modified 36 mer | | [mAs][mA][mG][mA][mU][mC][mU][fG][fA][fA][fU][mG][mG][mA][mA][mA][mC][mA][mA][mA][mG][mC][mA][mG][mC][mC][mG][ademA-GalNAc][ademA-GalNAc][ademA-GalNAc][mG][mG][mC][mU][mG][mC] | 1044 |
| STAT3-1001 | Modified 36 mer | | [mGs][mA][mA][mA][mA][mC][mU][fG][fG][fA][fU][mA][mA][mC][mG][mU][mC][mA][mU][mA][mG][mC][mA][mG][mC][mC][mG][ademA-GalNAc][ademA-GalNAc][ademA-GalNAc][mG][mG][mC][mU][mG][mC] | 1045 |
| STAT3-1006 | Modified 36 mer | | [mCs][mU][mG][mG][mA][mU][mA][fA][fC][fG][fU][mC][mA][mU][mU][mA][mG][mC][mA][mA][mG][mC][mA][mG][mC][mC][mG][ademA-GalNAc][ademA-GalNAc][ademA-GalNAc][mG][mG][mC][mU][mG][mC] | 1046 |
| STAT3-1145 | Modified 36 mer | | [mCs][mU][mG][mU][mU][mU][mA][fG][fA][fA][fA][mC][mU][mU][mA][mA][mU][mG][mA][mA][mG][mC][mA][mG][mC][mC][mG][ademA-GalNAc][ademA-GalNAc][ademA-GalNAc][mG][mG][mC][mU][mG][mC] | 1047 |
| STAT3-1151 | Modified 36 mer | | [mAs][mG][mA][mA][mA][mC][mU][fU][fA][fA][fU][mG][mA][mA][mA][mA][mG][mU][mG][mA][mG][mC][mA][mG][mC][mC][mG][ademA-GalNAc][ademA-GalNAc][ademA-GalNAc][mG][mG][mC][mU][mG][mC] | 1048 |
| STAT3-1268 | Modified 36 mer | | [mGs][mU][mC][mA][mA][mA][mU][fU][fC][fC][fC][mU][mG][mA][mG][mU][mU][mG][mA][mA][mG][mC][mA][mG][mC][mC][mG][ademA-GalNAc][ademA-GalNAc][ademA-GalNAc][mG][mG][mC][mU][mG][mC] | 1049 |
| STAT3-1273 | Modified 36 mer | | [mAs][mU][mU][mC][mC][mC][mU][fG][fA][fG][fU][mU][mG][mA][mA][mU][mU][mA][mU][mA][mG][mC][mA][mG][mC][mC][mG][ademA-GalNAc][ademA-GalNAc][ademA-GalNAc][mG][mG][mC][mU][mG][mC] | 1050 |
| STAT3-1279 | Modified 36 mer | | [mUs][mG][mA][mG][mU][mU][mG][fA][fA][fU][fU][mA][mU][mC][mA][mG][mC][mU][mU][mA][mG][mC][mA][mG][mC][mC][mG][ademA-GalNAc][ademA-GalNAc][ademA-GalNAc][mG][mG][mC][mU][mG][mC] | 1051 |
| STAT3-1280 | Modified 36 mer | | [mGs][mA][mG][mU][mU][mG][mA][fA][fU][fU][fA][mU][mC][mA][mG][mC][mU][mU][mA][mA][mG][mC][mA][mG][mC][mC][mG][ademA-GalNAc][ademA-GalNAc][ademA-GalNAc][mG][mG][mC][mU][mG][mC] | 1052 |
| STAT3-1281 | Modified 36 mer | | [mAs][mG][mU][mU][mG][mA][mA][fU][fU][fA][fU][mC][mA][mG][mC][mU][mU][mA][mA][mA][mG][mC][mA][mG][mC][mC][mG][ademA-GalNAc][ademA-GalNAc][ademA-GalNAc][mG][mG][mC][mU][mG][mC] | 1053 |
| STAT3-1284 | Modified 36 mer | | [mUs][mG][mA][mA][mU][mU][mA][fU][fC][fA][fG][mC][mU][mU][mA][mA][mA][mA][mU][mA][mG][mC][mA][mG][mC][mC][mG][ademA-GalNAc][ademA-GalNAc][ademA-GalNAc][mG][mG][mC][mU][mG][mC] | 1054 |

-continued

SEQUENCE LISTING

| Name | Description | Species | Sequence | SEQ ID NO |
|---|---|---|---|---|
| STAT3-1286 | Modified 36 mer | | [mAs][mA][mU][mU][mA][mU][mC][fA][fG][fC][fU][mU][mA][mA][mA][mA][mU][mU][mA][mA][mG][mC][mA][mG][mC][mC][mG][ademA-GalNAc][ademA-GalNAc][ademA-GalNAc][mG][mG][mC][mU][mG][mC] | 1055 |
| STAT3-1287 | Modified 36 mer | | [mAs][mU][mU][mA][mU][mC][mA][fG][fC][fU][fU][mA][mA][mA][mA][mU][mU][mA][mA][mA][mG][mC][mA][mG][mC][mC][mG][ademA-GalNAc][ademA-GalNAc][ademA-GalNAc][mG][mG][mC][mU][mG][mC] | 1056 |
| STAT3-1292 | Modified 36 mer | | [mCs][mA][mG][mC][mU][mU][mA][fA][fA][fA][fU][mU][mA][mA][mA][mG][mU][mG][mU][mA][mG][mC][mA][mG][mC][mC][mG][ademA-GalNAc][ademA-GalNAc][ademA-GalNAc][mG][mG][mC][mU][mG][mC] | 1057 |
| STAT3-1293 | Modified 36 mer | | [mAs][mG][mC][mU][mU][mA][mA][fA][fA][fU][fU][mA][mA][mA][mG][mU][mG][mU][mG][mA][mG][mC][mA][mG][mC][mC][mG][ademA-GalNAc][ademA-GalNAc][ademA-GalNAc][mG][mG][mC][mU][mG][mC] | 1058 |
| STAT3-1819 | Modified 36 mer | | [mUs][mG][mU][mG][mA][mA][mU][fU][fA][fU][fU][mC][mA][mG][mG][mG][mU][mG][mU][mA][mG][mC][mA][mG][mC][mC][mG][ademA-GalNAc][ademA-GalNAc][ademA-GalNAc] [mG][mG][mC][mU][mG][mC] | 1059 |
| STAT3-1908 | Modified 36 mer | | [mAs][mC][mA][mA][mU][mA][mU][fC][fA][fU][fU][mG][mA][mC][mC][mU][mU][mG][mU][mA][mG][mC][mA][mG][mC][mC][mG][ademA-GalNAc][ademA-GalNAc][ademA-GalNAc][mG][mG][mC][mU][mG][mC] | 1060 |
| STAT3-1910 | Modified 36 mer | | [mAs][mA][mU][mA][mU][mC][mA][fU][fU][fG][fA][mC][mC][mU][mU][mG][mU][mG][mA][mA][mG][mC][mA][mG][mC][mC][mG][ademA-GalNAc][ademA-GalNAc][ademA-GalNAc][mG][mG][mC][mU][mG][mC] | 1061 |
| STAT3-1913 | Modified 36 mer | | [mAs][mU][mC][mA][mU][mU][mG][fA][fC][fC][fU][mU][mG][mU][mG][mA][mA][mA][mA][mA][mG][mC][mA][mG][mC][mC][mG][ademA-GalNAc][ademA-GalNAc][ademA-GalNAc][mG][mG][mC][mU][mG][mC] | 1062 |
| STAT3-2154 | Modified 36 mer | | [mUs][mG][mU][mC][mA][mU][mU][fU][fG][fC][fU][mG][mA][mA][mA][mU][mC][mA][mU][mA][mG][mC][mA][mG][mC][mC][mG][ademA-GalNAc][ademA-GalNAc][ademA-GalNAc][mG][mG][mC][mU][mG][mC] | 1063 |
| STAT3-2327 | Modified 36 mer | | [mCs][mU][mG][mA][mA][mG][mA][fC][fC][fA][fA][mG][mU][mU][mU][mA][mU][mC][mU][mA][mG][mC][mA][mG][mC][mC][mG][ademA-GalNAc][ademA-GalNAc][ademA-GalNAc][mG][mG][mC][mU][mG][mC] | 1064 |
| STAT3-2335 | Modified 36 mer | | [mCs][mA][mA][mG][mU][mU][mU][fA][fU][fC][fU][mG][mU][mG][mU][mG][mA][mC][mA][mA][mG][mC][mA][mG][mC][mC][mG][ademA-GalNAc][ademA-GalNAc][ademA-GalNAc][mG][mG][mC][mU][mG][mC] | 1065 |
| STAT3-2418 | Modified 36 mer | | [mAs][mG][mU][mU][mU][mG][mG][fA][fA][fA][fU][mA][mA][mU][mG][mG][mU][mG][mA][mA][mG][mC][mA][mG][mC][mC][mG][ademA-GalNAc][ademA-GalNAc][ademA-GalNAc][mG][mG][mC][mU][mG][mC] | 1066 |

-continued

SEQUENCE LISTING

| Name | Description | Species | Sequence | SEQ ID NO |
|---|---|---|---|---|
| STAT3-2692 | Modified 36 mer | | [mAs][mA][mA][mU][mA][mG][mA][fG][fA][fA][fA][mU][mG][mA][mG][mU][mG][mA][mA][mA][mG][mC][mA][mG][mC][mC][mG][ademA-GalNAc][ademA-GalNAc][ademA-GalNAc][mG][mG][mC][mU][mG][mC] | 1067 |
| STAT3-2693 | Modified 36 mer | | [mAs][mA][mU][mA][mG][mA][mG][fA][fA][fA][fU][mG][mA][mG][mU][mG][mA][mA][mU][mA][mG][mC][mA][mG][mC][mC][mG][ademA-GalNAc][ademA-GalNAc][ademA-GalNAc][mG][mG][mC][mU][mG][mC] | 1068 |
| STAT3-2627 | Modified 36 mer | Hs-Mf-Mm | [mUs][mU][mG][mU][mG][mG][mU][fU][fC][fC][fA][mG][mA][mU][mU][mU][mU][mU][mU][mA][mG][mC][mA][mG][mC][mC][mG][ademA-GalNAc][ademA-GalNAc][ademA-GalNAc][mG][mG][mC][mU][mG][mC] | 1069 |
| STAT3-2626 | Modified 36 mer | Hs-Mf-Mm | [mUs][mU][mU][mG][mU][mG][mG][fU][fU][fC][fC][mA][mG][mA][mU][mU][mU][mU][mU][mA][mG][mC][mA][mG][mC][mC][mG][ademA-GalNAc][ademA-GalNAc][ademA-GalNAc][mG][mG][mC][mU][mG][mC] | 1070 |
| STAT3-2407 | Modified 36 mer | Hs-Mf-Mm | [mUs][mU][mC][mA][mU][mU][mG][fA][fU][fG][fC][mA][mG][mU][mU][mU][mG][mG][mA][mA][mG][mC][mA][mG][mC][mC][mG][ademA-GalNAc][ademA-GalNAc][ademA-GalNAc][mG][mG][mC][mU][mG][mC] | 1071 |
| STAT3-2412 | Modified 36 mer | Hs-Mf-Mm | [mUs][mG][mA][mU][mG][mC][mA][fG][fU][fU][fU][mG][mG][mA][mA][mA][mU][mA][mA][mA][mG][mC][mA][mG][mC][mC][mG][ademA-GalNAc][ademA-GalNAc][ademA-GalNAc][mG][mG][mC][mU][mG][mC] | 1072 |
| STAT3-2151 | Modified 36 mer | Hs-Mf-Mm | [mAs][mC][mA][mU][mG][mU][mC][fA][fU][fU][fU][mG][mC][mU][mG][mA][mA][mA][mU][mA][mG][mC][mA][mG][mC][mC][mG][ademA-GalNAc][ademA-GalNAc][ademA-GalNAc][mG][mG][mC][mU][mG][mC] | 1073 |
| STAT3-2625 | Modified 36 mer | Hs-Mf-Mm | [mCs][mU][mU][mU][mG][mU][mG][fG][fU][fU][fC][mC][mA][mG][mA][mU][mU][mU][mU][mA][mG][mC][mA][mG][mC][mC][mG][ademA-GalNAc][ademA-GalNAc][ademA-GalNAc][mG][mG][mC][mU][mG][mC] | 1074 |
| STAT3-4836 | Modified 36 mer | Hs-Mf-Mm | [mUs][mA][mA][mA][mA][mA][mU][fU][fU][fA][fU][mA][mU][mU][mA][mU][mU][mG][mU][mA][mG][mC][mA][mG][mC][mC][mG][ademA-GalNAc][ademA-GalNAc][ademA-GalNAc][mG][mG][mC][mU][mG][mC] | 1075 |
| STAT3-2408 | Modified 36 mer | Hs-Mf-Mm | [mUs][mC][mA][mU][mU][mG][mA][fU][fG][fC][fA][mG][mU][mU][mU][mG][mG][mA][mA][mA][mG][mC][mA][mG][mC][mC][mG][ademA-GalNAc][ademA-GalNAc][ademA-GalNAc][mG][mG][mC][mU][mG][mC] | 1076 |
| STAT3-2159 | Modified 36 mer | Hs-Mf-Mm | [mUs][mU][mU][mG][mC][mU][mG][fA][fA][fA][fU][mC][mA][mU][mC][mA][mU][mG][mG][mA][mG][mC][mA][mG][mC][mC][mG][ademA-GalNAc][ademA-GalNAc][ademA-GalNAc][mG][mG][mC][mU][mG][mC] | 1077 |
| STAT3-2146 | Modified 36 mer | Hs-Mf-Mm | [mGs][mA][mA][mC][mA][mA][mC][fA][fU][fG][fU][mC][mA][mU][mU][mU][mG][mC][mU][mA][mG][mC][mA][mG][mC][mC][mG][ademA-GalNAc][ademA-GalNAc][ademA-GalNAc][mG][mG][mC][mU][mG][mC] | 1078 |

-continued

SEQUENCE LISTING

| Name | Description | Species | Sequence | SEQ ID NO |
|---|---|---|---|---|
| STAT3-2148 | Modified 36 mer | Hs-Mf-Mm | [mAs][mC][mA][mA][mC][mA][mU][fG][fU][fC][fA][mU][mU][mU][mG][mC][mU][mG][mA][mA][mG][mC][mA][mG][mC][mC][mG][ademA-GalNAc][ademA-GalNAc][ademA-GalNAc][mG][mG][mC][mU][mG][mC] | 1079 |
| STAT3-2147 | Modified 36 mer | Hs-Mf-Mm | [mAs][mA][mC][mA][mA][mC][mA][fU][fG][fU][fC][mA][mU][mU][mU][mG][mC][mU][mG][mA][mG][mC][mA][mG][mC][mC][mG][ademA-GalNAc][ademA-GalNAc][ademA-GalNAc][mG][mG][mC][mU][mG][mC] | 1080 |
| STAT3-0461 | Modified 36 mer | Hs-Mf-Mm | [mCs][mG][mA][mA][mG][mA][mA][fU][fC][fA][fA][mG][mC][mA][mG][mU][mU][mU][mC][mA][mG][mC][mA][mG][mC][mC][mG][ademA-GalNAc][ademA-GalNAc][ademA-GalNAc][mG][mG][mC][mU][mG][mC] | 1081 |
| STAT3-1584 | Modified 36 mer | Hs-Mf-Mm | [mCs][mC][mU][mU][mG][mC][mC][fA][fG][fU][fU][mG][mU][mG][mG][mU][mG][mA][mU][mA][mG][mC][mA][mG][mC][mC][mG][ademA-GalNAc][ademA-GalNAc][ademA-GalNAc][mG][mG][mC][mU][mG][mC] | 1082 |
| STAT3-1047 | Modified 36 mer | Hs-Mf-Mm | [mAs][mA][mC][mA][mA][mA][mU][fU][fA][fA][fG][mA][mA][mA][mC][mU][mG][mG][mA][mA][mG][mC][mA][mG][mC][mC][mG][ademA-GalNAc][ademA-GalNAc][ademA-GalNAc][mG][mG][mC][mU][mG][mC] | 1083 |
| STAT3-0773 | Modified 36 mer | Hs-Mf-Mm | [mCs][mU][mG][mA][mA][mU][mG][fG][fA][fA][fA][mC][mA][mA][mC][mC][mA][mG][mU][mA][mG][mC][mA][mG][mC][mC][mG][ademA-GalNAc][ademA-GalNAc][ademA-GalNAc][mG][mG][mC][mU][mG][mC] | 1084 |
| STAT3-0492 | Modified 36 mer | Hs-Mf-Mm | [mAs][mU][mC][mU][mU][mG][mA][fG][fA][fA][fG][mC][mC][mA][mA][mU][mG][mG][mA][mA][mG][mC][mA][mG][mC][mC][mG][ademA-GalNAc][ademA-GalNAc][ademA-GalNAc][mG][mG][mC][mU][mG][mC] | 1085 |
| STAT3-0462 | Modified 36 mer | Hs-Mf-Mm | [mGs][mA][mA][mG][mA][mA][mU][fC][fA][fA][fG][mC][mA][mG][mU][mU][mU][mC][mU][mA][mG][mC][mA][mG][mC][mC][mG][ademA-GalNAc][ademA-GalNAc][ademA-GalNAc][mG][mG][mC][mU][mG][mC] | 1086 |
| STAT3-1586 | Modified 36 mer | Hs-Mf-Mm | [mUs][mU][mG][mC][mC][mA][mG][fU][fU][fG][fU][mG][mG][mU][mG][mA][mU][mC][mU][mA][mG][mC][mA][mG][mC][mC][mG][ademA-GalNAc][ademA-GalNAc][ademA-GalNAc][mG][mG][mC][mU][mG][mC] | 1087 |
| STAT3-0771 | Modified 36 mer | Hs-Mf-Mm | [mAs][mU][mC][mU][mG][mA][mA][fU][fG][fG][fA][mA][mA][mC][mA][mA][mC][mC][mA][mA][mG][mC][mA][mG][mC][mC][mG][ademA-GalNAc][ademA-GalNAc][ademA-GalNAc][mG][mG][mC][mU][mG][mC] | 1088 |
| STAT3-0681 | Modified 36 mer | Hs-Mf-Mm | [mAs][mU][mC][mU][mA][mG][mA][fA][fC][fA][fG][mA][mA][mA][mU][mG][mA][mA][mA][mG][mC][mA][mG][mC][mC][mG][ademA-GalNAc][ademA-GalNAc][ademA-GalNAc][mG][mG][mC][mU][mG][mC] | 1089 |
| STAT3-0678 | Modified 36 mer | Hs-Mf-Mm | [mAs][mG][mG][mA][mU][mC][mU][fA][fG][fA][fA][mC][mA][mG][mA][mA][mA][mU][mA][mG][mC][mA][mG][mC][mC][mG][ademA-GalNAc][ademA-GalNAc][ademA-GalNAc][mG][mG][mC][mU][mG][mC] | 1090 |

-continued

SEQUENCE LISTING

| Name | Description | Species | Sequence | SEQ ID NO |
|---|---|---|---|---|
| STAT3-4837 | Modified 36 mer | Hs-Mf-Mm | [mAs][mA][mA][mA][mA][mU][mU][fU][fA][fU][fA][mU][mU][mA][mU][mU][mG][mU][mG][mA][mG][mC][mA][mG][mC][mC][mG][ademA-GalNAc][ademA-GalNAc][ademA-GalNAc][mG][mG][mC][mU][mG][mC] | 1091 |
| STAT3-4833 | Modified 36 mer | Hs-Mf-Mm | [mGs][mU][mG][mU][mA][mA][mA][fA][fA][fU][fU][mU][mA][mU][mA][mU][mU][mA][mU][mA][mG][mC][mA][mG][mC][mC][mG][ademA-GalNAc][ademA-GalNAc][ademA-GalNAc][mG][mG][mC][mU][mG][mC] | 1092 |
| STAT3-1068 | Modified 36 mer | Hs | [mAs][mG][mU][mU][mG][mC][mA][fG][fC][fA][fA][mA][mA][mA][mG][mU][mU][mU][mC][mA][mG][mC][mA][mG][mC][mC][mG][ademA-GalNAc][ademA-GalNAc][ademA-GalNAc][mG][mG][mC][mU][mG][mC] | 1093 |
| STAT3-1673 | Modified 36 mer | Hs | [mAs][mA][mG][mA][mA][mU][mG][fU][fA][fA][fA][mC][mU][mU][mU][mU][mU][mU][mA][mA][mG][mC][mA][mG][mC][mC][mG][ademA-GalNAc][ademA-GalNAc][ademA-GalNAc][mG][mG][mC][mU][mG][mC] | 1094 |
| STAT3-0426 | Modified 36 mer | Hs | [mUs][mG][mC][mA][mA][mG][mA][fG][fU][fC][fG][mA][mA][mU][mG][mU][mU][mC][mU][mA][mG][mC][mA][mG][mC][mC][mG][ademA-GalNAc][ademA-GalNAc][ademA-GalNAc][mG][mG][mC][mU][mG][mC] | 1095 |
| STAT3-2404 | Modified 36 mer | Hs | [mAs][mG][mA][mU][mU][mC][mA][fU][fU][fG][fA][mU][mG][mC][mA][mG][mU][mU][mU][mA][mG][mC][mA][mG][mC][mC][mG][ademA-GalNAc][ademA-GalNAc][ademA-GalNAc][mG][mG][mC][mU][mG][mC] | 1096 |
| STAT3-1067 | Modified 36 mer | Hs | [mGs][mA][mG][mU][mU][mG][mC][fA][fG][fC][fA][mA][mA][mA][mA][mG][mU][mU][mU][mA][mG][mC][mA][mG][mC][mC][mG][ademA-GalNAc][ademA-GalNAc][ademA-GalNAc][mG][mG][mC][mU][mG][mC] | 1097 |
| STAT3-0433 | Modified 36 mer | Hs | [mGs][mU][mC][mG][mA][mA][mU][fG][fU][fU][fC][mU][mC][mU][mA][mU][mC][mA][mG][mA][mG][mC][mA][mG][mC][mC][mG][ademA-GalNAc][ademA-GalNAc][ademA-GalNAc][mG][mG][mC][mU][mG][mC] | 1098 |
| STAT3-1670 | Modified 36 mer | Hs | [mCs][mC][mC][mA][mA][mG][mA][fA][fU][fG][fU][mA][mA][mA][mC][mU][mU][mU][mU][mA][mG][mC][mA][mG][mC][mC][mG][ademA-GalNAc][ademA-GalNAc][ademA-GalNAc][mG][mG][mC][mU][mG][mC] | 1099 |
| STAT3-1388 | Modified 36 mer | Hs | [mGs][mU][mG][mA][mU][mG][mA][fA][fC][fA][fU][mG][mG][mA][mA][mG][mA][mA][mU][mA][mG][mC][mA][mG][mC][mC][mG][ademA-GalNAc][ademA-GalNAc][ademA-GalNAc][mG][mG][mC][mU][mG][mC] | 1100 |
| STAT3-0429 | Modified 36 mer | Hs | [mAs][mA][mG][mA][mG][mU][mC][fG][fA][fA][fU][mG][mU][mU][mC][mU][mC][mU][mA][mA][mG][mC][mA][mG][mC][mC][mG][ademA-GalNAc][ademA-GalNAc][ademA-GalNAc][mG][mG][mC][mU][mG][mC] | 1101 |
| STAT3-2405 | Modified 36 mer | Hs | [mGs][mA][mU][mU][mC][mA][mU][fU][fG][fA][fU][mG][mC][mA][mG][mU][mU][mU][mG][mA][mG][mC][mA][mG][mC][mC][mG][ademA-GalNAc][ademA-GalNAc][ademA-GalNAc][mG][mG][mC][mU][mG][mC] | 1102 |

-continued

SEQUENCE LISTING

| Name | Description | Species | Sequence | SEQ ID NO |
|---|---|---|---|---|
| STAT3-0430 | Modified 36 mer | Hs | [mAs][mG][mA][mG][mU][mC][mG][fA][fA][fU][fG][mU][mU][mC][mU][mC][mU][mA][mU][mA][mG][mC][mA][mG][mC][mC][mG][ademA-GalNAc][ademA-GalNAc][ademA-GalNAc][mG][mG][mC][mU][mG][mC] | 1103 |
| STAT3-0432 | Modified 36 mer | Hs | [mAs][mG][mU][mC][mG][mA][mA][fU][fG][fU][fU][mC][mU][mC][mU][mA][mU][mC][mA][mA][mG][mC][mA][mG][mC][mC][mG][ademA-GalNAc][ademA-GalNAc][ademA-GalNAc][mG][mG][mC][mU][mG][mC] | 1104 |
| STAT3-1815 | Modified 36 mer | Hs | [mCs][mU][mG][mG][mU][mG][mU][fG][fA][fA][fU][mU][mA][mU][mU][mC][mA][mG][mG][mA][mG][mC][mA][mG][mC][mC][mG][ademA-GalNAc][ademA-GalNAc][ademA-GalNAc][mG][mG][mC][mU][mG][mC] | 1105 |
| STAT3-0424 | Modified 36 mer | Hs | [mCs][mC][mU][mG][mC][mA][mA][fG][fA][fG][fU][mC][mG][mA][mA][mU][mG][mU][mU][mA][mG][mC][mA][mG][mC][mC][mG][ademA-GalNAc][ademA-GalNAc][ademA-GalNAc][mG][mG][mC][mU][mG][mC] | 1106 |
| STAT3-2024 | Modified 36 mer | Hs | [mAs][mC][mC][mU][mU][mC][mC][fU][fG][fC][fU][mA][mA][mG][mA][mU][mU][mC][mA][mA][mG][mC][mA][mG][mC][mC][mG][ademA-GalNAc][ademA-GalNAc][ademA-GalNAc][mG][mG][mC][mU][mG][mC] | 1107 |
| STAT3-1813 | Modified 36 mer | Hs | [mAs][mC][mC][mU][mG][mG][mU][fG][fU][fG][fA][mA][mU][mU][mA][mU][mU][mC][mA][mA][mG][mC][mA][mG][mC][mC][mG][ademA-GalNAc][ademA-GalNAc][ademA-GalNAc][mG][mG][mC][mU][mG][mC] | 1108 |
| STAT3-1674 | Modified 36 mer | Hs | [mAs][mG][mA][mA][mU][mG][mU][fA][fA][fA][fC][mU][mU][mU][mU][mU][mU][mA][mC][mA][mG][mC][mA][mG][mC][mC][mG][ademA-GalNAc][ademA-GalNAc][ademA-GalNAc] [mG][mG][mC][mU][mG][mC] | 1109 |
| STAT3-1241 | Modified 36 mer | Hs | [mCs][mA][mG][mU][mU][mC][mA][fC][fU][fA][fC][mU][mA][mA][mA][mG][mU][mC][mA][mA][mG][mC][mA][mG][mC][mC][mG][ademA-GalNAc][ademA-GalNAc][ademA-GalNAc][mG][mG][mC][mU][mG][mC] | 1110 |
| STAT3-1672 | Modified 36 mer | Hs | [mCs][mA][mA][mG][mA][mA][mU][fG][fU][fA][fA][mA][mC][mU][mU][mU][mU][mU][mU][mA][mG][mC][mA][mG][mC][mC][mG][ademA-GalNAc][ademA-GalNAc][ademA-GalNAc][mG][mG][mC][mU][mG][mC] | 1111 |
| STAT3-0425 | Modified 36 mer | Hs | [mCs][mU][mG][mC][mA][mA][mG][fA][fG][fU][fC][mG][mA][mA][mU][mG][mU][mU][mC][mA][mG][mC][mA][mG][mC][mC][mG][ademA-GalNAc][ademA-GalNAc][ademA-GalNAc][mG][mG][mC][mU][mG][mC] | 1112 |
| STAT3-1817 | Modified 36 mer | Hs | [mGs][mG][mU][mG][mU][mG][mA][fA][fU][fU][fA][mU][mU][mC][mA][mG][mG][mG][mU][mA][mG][mC][mA][mG][mC][mC][mG][ademA-GalNAc][ademA-GalNAc][ademA-GalNAc][mG][mG][mC][mU][mG][mC] | 1113 |
| STAT3-1671 | Modified 36 mer | Hs | [mCs][mC][mA][mA][mG][mA][mA][fU][fG][fU][fA][mA][mA][mC][mU][mU][mU][mU][mU][mA][mG][mC][mA][mG][mC][mC][mG][ademA-GalNAc][ademA-GalNAc][ademA-GalNAc][mG][mG][mC][mU][mG][mC] | 1114 |

-continued

SEQUENCE LISTING

| Name | Description | Species | Sequence | SEQ ID NO |
|---|---|---|---|---|
| STAT3-2136 | Modified 36 mer | Hs-Mm | [mAs][mG][mC][mA][mG][mC][mA][fG][fC][fU][fG][mA][mA][mC][mA][mA][mC][mA][mU][mA][mG][mC][mA][mG][mC][mC][mG][ademA-GalNAc][ademA-GalNAc][ademA-GalNAc][mG][mG][mC][mU][mG][mC] | 1115 |
| STAT3-2143 | Modified 36 mer | Hs-Mm | [mGs][mC][mU][mG][mA][mA][mC][fA][fA][fC][fA][mU][mG][mU][mC][mA][mU][mU][mU][mA][mG][mC][mA][mG][mC][mC][mG][ademA-GalNAc][ademA-GalNAc][ademA-GalNAc][mG][mG][mC][mU][mG][mC] | 1116 |
| STAT3-2144 | Modified 36 mer | Hs-Mm | [mCs][mU][mG][mA][mA][mC][mA][fA][fC][fA][fU][mG][mU][mC][mA][mU][mU][mU][mG][mA][mG][mC][mA][mG][mC][mC][mG][ademA-GalNAc][ademA-GalNAc][ademA-GalNAc][mG][mG][mC][mU][mG][mC] | 1117 |
| STAT3-2138 | Modified 36 mer | Hs-Mm | [mCs][mA][mG][mC][mA][mG][mC][fU][fG][fA][fA][mC][mA][mA][mC][mA][mU][mG][mU][mA][mG][mC][mA][mG][mC][mC][mG][ademA-GalNAc][ademA-GalNAc][ademA-GalNAc][mG][mG][mC][mU][mG][mC] | 1118 |
| STAT3-4909 | Modified 36 mer | Hs-Mm | [mUs][mU][mU][mA][mA][mC][mU][fU][fC][fC][fA][mG][mA][mA][mA][mU][mA][mA][mA][mA][mG][mC][mA][mG][mC][mC][mG][ademA-GalNAc][ademA-GalNAc][ademA-GalNAc][mG][mG][mC][mU][mG][mC] | 1119 |
| STAT3-2139 | Modified 36 mer | Hs-Mm | [mAs][mG][mC][mA][mG][mC][mU][fG][fA][fA][fC][mA][mA][mC][mA][mU][mG][mU][mC][mA][mG][mC][mA][mG][mC][mC][mG][ademA-GalNAc][ademA-GalNAc][ademA-GalNAc][mG][mG][mC][mU][mG][mC] | 1120 |
| STAT3-2411 | Modified 36 mer | Hs-Mm | [mUs][mU][mG][mA][mU][mG][mC][fA][fG][fU][fU][mU][mG][mG][mA][mA][mA][mU][mA][mA][mG][mC][mA][mG][mC][mC][mG][ademA-GalNAc][ademA-GalNAc][ademA-GalNAc][mG][mG][mC][mU][mG][mC] | 1121 |
| STAT3-2145 | Modified 36 mer | Hs-Mm | [mUs][mG][mA][mA][mC][mA][mA][fC][fA][fU][fG][mU][mC][mA][mU][mU][mU][mG][mC][mA][mG][mC][mA][mG][mC][mC][mG][ademA-GalNAc][ademA-GalNAc][ademA-GalNAc][mG][mG][mC][mU][mG][mC] | 1122 |
| STAT3-4831 | Modified 36 mer | Hs-Mm | [mUs][mA][mG][mU][mG][mU][mA][fA][fA][fA][fA][mU][mU][mU][mA][mU][mA][mU][mU][mA][mG][mC][mA][mG][mC][mC][mG][ademA-GalNAc][ademA-GalNAc][ademA-GalNAc][mG][mG][mC][mU][mG][mC] | 1123 |
| STAT3-2622 | Modified 36 mer | Hs-Mm | [mUs][mA][mA][mC][mU][mU][mU][fG][fU][fG][fG][mU][mU][mC][mC][mA][mG][mA][mU][mA][mG][mC][mA][mG][mC][mC][mG][ademA-GalNAc][ademA-GalNAc][ademA-GalNAc][mG][mG][mC][mU][mG][mC] | 1124 |
| STAT3-2135 | Modified 36 mer | Hs-Mm | [mAs][mA][mG][mC][mA][mG][mC][fA][fG][fC][fU][mG][mA][mA][mC][mA][mA][mC][mA][mA][mG][mC][mA][mG][mC][mC][mG][ademA-GalNAc][ademA-GalNAc][ademA-GalNAc][mG][mG][mC][mU][mG][mC] | 1125 |
| STAT3-1383 | Modified 36 mer | Hs-Mm | [mCs][mA][mA][mA][mA][mG][mU][fG][fA][fU][fG][mA][mA][mC][mA][mU][mG][mG][mA][mA][mG][mC][mA][mG][mC][mC][mG][ademA-GalNAc][ademA-GalNAc][ademA-GalNAc][mG][mG][mC][mU][mG][mC] | 1126 |

-continued

SEQUENCE LISTING

| Name | Description | Species | Sequence | SEQ ID NO |
|---|---|---|---|---|
| STAT3-715 | Modified 22 mer | | [MePhosphonate-4O-mUs][fGs][fAs][fA][fA][mU][fC][mA][mA][fA][mG][mU][mC][fA][mU][mC][mC][mU][mG][mGs][mGs][mG] | 1127 |
| STAT3-716 | Modified 22 mer | | [MePhosphonate-4O-mUs][fUs][fGs][fA][fA][mA][fU][mC][mA][fA][mA][mG][mU][fC][mA][mU][mC][mC][mU][mGs][mGs][mG] | 1128 |
| STAT3-717 | Modified 22 mer | | [MePhosphonate-4O-mUs][fUs][fUs][fG][fA][mA][fA][mU][mC][fA][mA][mA][mG][fU][mC][mA][mU][mC][mC][mUs][mGs][mG] | 1129 |
| STAT3-720 | Modified 22 mer | | [MePhosphonate-4O-mUs][fUs][fAs][fG][fU][mU][fG][mA][mA][fA][mU][mC][mA][fA][mA][mG][mU][mC][mA][mUs][mGs][mG] | 1130 |
| STAT3-372 | Modified 22 mer | | [MePhosphonate-4O-mUs][fAs][fGs][fA][fU][mU][fA][mU][mG][fA][mA][mA][mC][fA][mC][mC][mA][mA][mA][mGs][mGs][mG] | 1131 |
| STAT3-721 | Modified 22 mer | | [MePhosphonate-4O-mUs][fAs][fUs][fA][fG][mU][fU][mG][mA][fA][mA][mU][mC][fA][mA][mA][mG][mU][mC][mAs][mGs][mG] | 1132 |
| STAT3-722 | Modified 22 mer | | [MePhosphonate-4O-mUs][fUs][fAs][fU][fA][mG][fU][mU][mG][fA][mA][mA][mU][fC][mA][mA][mA][mG][mU][mCs][mGs][mG] | 1133 |
| STAT3-768 | Modified 22 mer | | [MePhosphonate-4O-mUs][fUs][fUs][fG][fU][mU][fU][mC][mC][fA][mU][mU][mC][fA][mG][mA][mU][mC][mU][mUs][mGs][mG] | 1134 |
| STAT3-1001 | Modified 22 mer | | [MePhosphonate-4O-mUs][fAs][fUs][fG][fA][mC][fG][mU][mU][fA][mU][mC][mC][fA][mG][mU][mU][mU][mU][mCs][mGs][mG] | 1135 |
| STAT3-1006 | Modified 22 mer | | [MePhosphonate-4O-mUs][fUs][fGs][fC][fU][mA][fA][mU][mG][fA][mC][mG][mU][fU][mA][mU][mC][mC][mA][mGs][mGs][mG] | 1136 |
| STAT3-1145 | Modified 22 mer | | [MePhosphonate-4O-mUs][fUs][fCs][fA][fU][mU][fA][mA][mG][fU][mU][mU][mC][fU][mA][mA][mA][mC][mA][mGs][mGs][mG] | 1137 |
| STAT3-1151 | Modified 22 mer | | [MePhosphonate-4O-mUs][fCs][fAs][fC][fU][mU][fU][mU][mC][fA][mU][mU][mA][fA][mG][mU][mU][mU][mC][mUs][mGs][mG] | 1138 |
| STAT3-1268 | Modified 22 mer | | [MePhosphonate-4O-mUs][fUs][fCs][fA][fA][mC][fU][mC][mA][fG][mG][mG][mA][fA][mU][mU][mU][mG][mA][mCs][mGs][mG] | 1139 |
| STAT3-1273 | Modified 22 mer | | [MePhosphonate-4O-mUs][fAs][fUs][fA][fA][mU][fU][mC][mA][fA][mC][mU][mC][fA][mG][mG][mG][mA][mA][mUs][mGs][mG] | 1140 |
| STAT3-1279 | Modified 22 mer | | [MePhosphonate-4O-mUs][fAs][fAs][fG][fC][mU][fG][mA][mU][fA][mA][mU][mU][fC][mA][mA][mC][mU][mC][mAs][mGs][mG] | 1141 |
| STAT3-1280 | Modified 22 mer | | [MePhosphonate-4O-mUs][fUs][fAs][fA][fG][mC][fU][mG][mA][fU][mA][mA][mU][fU][mC][mA][mA][mC][mU][mCs][mGs][mG] | 1142 |
| STAT3-1281 | Modified 22 mer | | [MePhosphonate-4O-mUs][fUs][fUs][fA][fA][mG][fC][mU][mG][fA][mU][mA][mA][fU][mU][mC][mA][mA][mC][mUs][mGs][mG] | 1143 |
| STAT3-1284 | Modified 22 mer | | [MePhosphonate-4O-mUs][fAs][fUs][fU][fU][mU][fA][mA][mG][fC][mU][mG][mA][fU][mA][mA][mU][mU][mC][mAs][mGs][mG] | 1144 |

-continued

SEQUENCE LISTING

| Name | Description | Species | Sequence | SEQ ID NO |
|---|---|---|---|---|
| STAT3-1286 | Modified 22 mer | | [MePhosphonate-4O-mUs][fUs][fAs][fA][fU][mU][fU][mU][mA][fA][mG][mC][mU][fG][mA][mU][mA][mA][mU][mUs][mGs][mG] | 1145 |
| STAT3-1287 | Modified 22 mer | | [MePhosphonate-4O-mUs][fUs][fUs][fA][fA][mU][fU][mU][mU][fA][mA][mG][mC][fU][mG][mA][mU][mA][mA][mUs][mGs][mG] | 1146 |
| STAT3-1292 | Modified 22 mer | | [MePhosphonate-4O-mUs][fAs][fCs][fA][fC][mU][fU][mU][mA][fA][mU][mU][mU][fU][mA][mA][mG][mC][mU][mGs][mGs][mG] | 1147 |
| STAT3-1293 | Modified 22 mer | | [MePhosphonate-4O-mUs][fCs][fAs][fC][fA][mC][fU][mU][mU][fA][mA][mU][mU][fU][mU][mA][mA][mG][mC][mUs][mGs][mG] | 1148 |
| STAT3-1819 | Modified 22 mer | | [MePhosphonate-4O-mUs][fAs][fCs][fA][fC][mC][fC][mU][mG][fA][mA][mU][mA][fA][mU][mU][mC][mA][mC][mAs][mGs][mG] | 1149 |
| STAT3-1908 | Modified 22 mer | | [MePhosphonate-4O-mUs][fAs][fCs][fA][fA][mG][fG][mU][mC][fA][mA][mU][mG][fA][mU][mA][mU][mU][mG][mUs][mGs][mG] | 1150 |
| STAT3-1910 | Modified 22 mer | | [MePhosphonate-4O-mUs][fUs][fCs][fA][fC][mA][fA][mG][mG][fU][mC][mA][mA][fU][mG][mA][mU][mA][mU][mUs][mGs][mG] | 1151 |
| STAT3-1913 | Modified 22 mer | | [MePhosphonate-4O-mUs][fUs][fUs][fU][fU][mC][fA][mC][mA][fA][mG][mG][mU][fC][mA][mA][mU][mG][mA][mUs][mGs][mG] | 1152 |
| STAT3-2154 | Modified 22 mer | | [MePhosphonate-4O-mUs][fAs][fUs][fG][fA][mU][fU][mU][mC][fA][mG][mC][mA][fA][mA][mU][mG][mA][mC][mAs][mGs][mG] | 1153 |
| STAT3-2327 | Modified 22 mer | | [MePhosphonate-4O-mUs][fAs][fGs][fA][fU][mA][fA][mA][mC][fU][mU][mG][mG][fU][mC][mU][mU][mC][mA][mGs][mGs][mG] | 1154 |
| STAT3-2335 | Modified 22 mer | | [MePhosphonate-4O-mUs][fUs][fGs][fU][fC][mA][fC][mA][mC][fA][mG][mA][mU][fA][mA][mA][mC][mU][mU][mGs][mGs][mG] | 1155 |
| STAT3-2418 | Modified 22 mer | | [MePhosphonate-4O-mUs][fUs][fCs][fA][fC][mC][fA][mU][mU][fA][mU][mU][mU][fC][mC][mA][mA][mA][mC][mUs][mGs][mG] | 1156 |
| STAT3-2692 | Modified 22 mer | | [MePhosphonate-4O-mUs][fUs][fUs][fC][fA][mC][fU][mC][mA][fU][mU][mU][mC][fU][mC][mU][mA][mU][mU][mUs][mGs][mG] | 1157 |
| STAT3-2693 | Modified 22 mer | | [MePhosphonate-4O-mUs][fAs][fUs][fU][fC][mA][fC][mU][mC][fA][mU][mU][mU][fC][mU][mC][mU][mA][mU][mUs][mGs][mG] | 1158 |
| STAT3-2627 | Modified 22 mer | Hs-Mf-Mm | [MePhosphonate-4O-mUs][fAs][fA][fA][fA][mA][fA][mU][mC][fU][mG][mG][mA][fA][mC][mC][mA][mC][mA][mAs][mGs][mG] | 1159 |
| STAT3-2626 | Modified 22 mer | Hs-Mf-Mm | [MePhosphonate-4O-mUs][fAs][fA][fA][fA][mA][fU][mC][mU][fG][mG][mA][mA][fC][mC][mA][mC][mA][mA][mAs][mGs][mG] | 1160 |
| STAT3-2407 | Modified 22 mer | Hs-Mf-Mm | [MePhosphonate-4O-mUs][fUs][fC][fC][fA][mA][fA][mC][mU][fG][mC][mA][mU][fC][mA][mA][mU][mG][mA][mAs][mGs][mG] | 1161 |
| STAT3-2412 | Modified 22 mer | Hs-Mf-Mm | [MePhosphonate-4O-mUs][fUs][fU][fA][fU][mU][fU][mC][mC][fA][mA][mA][mC][fU][mG][mC][mA][mU][mC][mAs][mGs][mG] | 1162 |

-continued

SEQUENCE LISTING

| Name | Description | Species | Sequence | SEQ ID NO |
|---|---|---|---|---|
| STAT3-2151 | Modified 22 mer | Hs-Mf-Mm | [MePhosphonate-4O-mUs][fAs][fU][fU][fU][mC][fA][mG][mC][fA][mA][mA][mU][fG][mA][mC][mA][mU][mG][mUs][mGs][mG] | 1163 |
| STAT3-2625 | Modified 22 mer | Hs-Mf-Mm | [MePhosphonate-4O-mUs][fAs][fA][fA][fA][mU][fC][mU][mG][fG][mA][mA][mC][fC][mA][mC][mA][mA][mA][mGs][mGs][mG] | 1164 |
| STAT3-4836 | Modified 22 mer | Hs-Mf-Mm | [MePhosphonate-4O-mUs][fAs][fC][fA][fA][mU][fA][mA][mU][fA][mU][mA][mA][fA][mU][mU][mU][mU][mU][mAs][mGs][mG] | 1165 |
| STAT3-2408 | Modified 22 mer | Hs-Mf-Mm | [MePhosphonate-4O-mUs][fUs][fU][fC][fC][mA][fA][mA][mC][fU][mG][mC][mA][fU][mC][mA][mA][mU][mG][mAs][mGs][mG] | 1166 |
| STAT3-2159 | Modified 22 mer | Hs-Mf-Mm | [MePhosphonate-4O-mUs][fCs][fC][fA][fU][mG][fA][mU][mG][fA][mU][mU][mU][fC][mA][mG][mC][mA][mA][mAs][mGs][mG] | 1167 |
| STAT3-2146 | Modified 22 mer | Hs-Mf-Mm | [MePhosphonate-4O-mUs][fAs][fG][fC][fA][mA][fA][mU][mG][fA][mC][mA][mU][fG][mU][mU][mG][mU][mU][mCs][mGs][mG] | 1168 |
| STAT3-2148 | Modified 22 mer | Hs-Mf-Mm | [MePhosphonate-4O-mUs][fUs][fC][fA][fG][mC][fA][mA][mA][fU][mG][mA][mC][fA][mU][mG][mU][mU][mG][mUs][mGs][mG] | 1169 |
| STAT3-2147 | Modified 22 mer | Hs-Mf-Mm | [MePhosphonate-4O-mUs][fCs][fA][fG][fC][mA][fA][mA][mU][fG][mA][mC][mA][fU][mG][mU][mU][mG][mU][mUs][mGs][mG] | 1170 |
| STAT3-0461 | Modified 22 mer | Hs-Mf-Mm | [MePhosphonate-4O-mUs][fGs][fA][fA][fA][mC][fU][mG][mC][fU][mU][mG][mA][fU][mU][mC][mU][mU][mC][mGs][mGs][mG] | 1171 |
| STAT3-1584 | Modified 22 mer | Hs-Mf-Mm | [MePhosphonate-4O-mUs][fAs][fU][fC][fA][mC][fC][mA][mC][fA][mA][mC][mU][fG][mG][mC][mA][mA][mG][mGs][mGs][mG] | 1172 |
| STAT3-1047 | Modified 22 mer | Hs-Mf-Mm | [MePhosphonate-4O-mUs][fUs][fC][fC][fA][mG][fU][mU][mU][fC][mU][mU][mA][fA][mU][mU][mU][mG][mU][mUs][mGs][mG] | 1173 |
| STAT3-0773 | Modified 22 mer | Hs-Mf-Mm | [MePhosphonate-4O-mUs][fAs][fC][fU][fG][mG][fU][mU][mG][fU][mU][mU][mC][fC][mA][mU][mU][mC][mA][mGs][mGs][mG] | 1174 |
| STAT3-0492 | Modified 22 mer | Hs-Mf-Mm | [MePhosphonate-4O-mUs][fUs][fC][fC][fA][mU][fU][mG][mG][fC][mU][mU][mC][fU][mC][mA][mA][mG][mA][mUs][mGs][mG] | 1175 |
| STAT3-0462 | Modified 22 mer | Hs-Mf-Mm | [MePhosphonate-4O-mUs][fAs][fG][fA][fA][mA][fC][mU][mG][fC][mU][mU][mG][fA][mU][mU][mC][mU][mU][mCs][mGs][mG] | 1176 |
| STAT3-1586 | Modified 22 mer | Hs-Mf-Mm | [MePhosphonate-4O-mUs][fAs][fG][fA][fU][mC][fA][mC][mC][fA][mC][mA][mA][fC][mU][mG][mG][mC][mA][mAs][mGs][mG] | 1177 |
| STAT3-0771 | Modified 22 mer | Hs-Mf-Mm | [MePhosphonate-4O-mUs][fUs][fG][fG][fU][mU][fG][mU][mU][fU][mC][mC][mA][fU][mU][mC][mA][mG][mA][mUs][mGs][mG] | 1178 |
| STAT3-0681 | Modified 22 mer | Hs-Mf-Mm | [MePhosphonate-4O-mUs][fUs][fU][fC][fA][mU][fU][mU][mU][fC][mU][mG][mU][fU][mC][mU][mA][mG][mA][mUs][mGs][mG] | 1179 |
| STAT3-0678 | Modified 22 mer | Hs-Mf-Mm | [MePhosphonate-4O-mUs][fAs][fU][fU][fU][mU][fC][mU][mG][fU][mU][mC][mU][fA][mG][mA][mU][mC][mC][mUs][mGs][mG] | 1180 |

-continued

SEQUENCE LISTING

| Name | Description | Species | Sequence | SEQ ID NO |
|---|---|---|---|---|
| STAT3-4837 | Modified 22 mer | Hs-Mf-Mm | [MePhosphonate-4O-mUs][fCs][fA][fC][fA][mA][fU][mA][mA][fU][mA][mU][mA][fA][mA][mU][mU][mU][mU][mUs][mGs][mG] | 1181 |
| STAT3-4833 | Modified 22 mer | Hs-Mf-Mm | [MePhosphonate-4O-mUs][fAs][fU][fA][fA][mU][fA][mU][mA][fA][mA][mU][mU][fU][mU][mU][mA][mC][mA][mCs][mGs][mG] | 1182 |
| STAT3-1068 | Modified 22 mer | Hs | [MePhosphonate-4O-mUs][fGs][fA][fA][fA][mC][fU][mU][mU][fU][mU][mG][mC][fU][mG][mC][mA][mA][mC][mUs][mGs][mG] | 1183 |
| STAT3-1673 | Modified 22 mer | Hs | [MePhosphonate-4O-mUs][fUs][fA][fA][fA][mA][fA][mA][mG][fU][mU][mU][mA][fC][mA][mU][mU][mC][mU][mUs][mGs][mG] | 1184 |
| STAT3-0426 | Modified 22 mer | Hs | [MePhosphonate-4O-mUs][fAs][fG][fA][fA][mC][fA][mU][mU][fC][mG][mA][mC][fU][mC][mU][mU][mG][mC][mAs][mGs][mG] | 1185 |
| STAT3-2404 | Modified 22 mer | Hs | [MePhosphonate-4O-mUs][fAs][fA][fA][fC][mU][fG][mC][mA][fU][mC][mA][mA][fU][mG][mA][mA][mU][mC][mUs][mGs][mG] | 1186 |
| STAT3-1067 | Modified 22 mer | Hs | [MePhosphonate-4O-mUs][fAs][fA][fA][fC][mU][fU][mU][mU][fU][mG][mC][mU][fG][mC][mA][mA][mC][mU][mCs][mGs][mG] | 1187 |
| STAT3-0433 | Modified 22 mer | Hs | [MePhosphonate-4O-mUs][fCs][fU][fG][fA][mU][fA][mG][mA][fG][mA][mA][mC][fA][mU][mU][mC][mG][mA][mCs][mGs][mG] | 1188 |
| STAT3-1670 | Modified 22 mer | Hs | [MePhosphonate-4O-mUs][fAs][fA][fA][fA][mG][fU][mU][mU][fA][mC][mA][mU][fU][mC][mU][mU][mG][mG][mGs][mGs][mG] | 1189 |
| STAT3-1388 | Modified 22 mer | Hs | [MePhosphonate-4O-mUs][fAs][fU][fU][fC][mU][fU][mC][mC][fA][mU][mG][mU][fU][mC][mA][mU][mC][mA][mCs][mGs][mG] | 1190 |
| STAT3-0429 | Modified 22 mer | Hs | [MePhosphonate-4O-mUs][fUs][fA][fG][fA][mG][fA][mA][mC][fA][mU][mU][mC][fG][mA][mC][mU][mC][mU][mUs][mGs][mG] | 1191 |
| STAT3-2405 | Modified 22 mer | Hs | [MePhosphonate-4O-mUs][fCs][fA][fA][fA][mC][fU][mG][mC][fA][mU][mC][mA][fA][mU][mG][mA][mA][mU][mCs][mGs][mG] | 1192 |
| STAT3-0430 | Modified 22 mer | Hs | [MePhosphonate-4O-mUs][fAs][fU][fA][fG][mA][fG][mA][mA][fC][mA][mU][mU][fC][mG][mA][mC][mU][mC][mUs][mGs][mG] | 1193 |
| STAT3-0432 | Modified 22 mer | Hs | [MePhosphonate-4O-mUs][fUs][fG][fA][fU][mA][fG][mA][mG][fA][mA][mC][mA][fU][mU][mC][mG][mA][mC][mUs][mGs][mG] | 1194 |
| STAT3-1815 | Modified 22 mer | Hs | [MePhosphonate-4O-mUs][fCs][fC][fU][fG][mA][fA][mU][mA][fA][mU][mU][mC][fA][mC][mA][mC][mC][mA][mGs][mGs][mG] | 1195 |
| STAT3-0424 | Modified 22 mer | Hs | [MePhosphonate-4O-mUs][fAs][fA][fC][fA][mU][fU][mC][mG][fA][mC][mU][mC][fU][mU][mG][mC][mA][mG][mGs][mGs][mG] | 1196 |
| STAT3-2024 | Modified 22 mer | Hs | [MePhosphonate-4O-mUs][fUs][fG][fA][fA][mU][fC][mU][mU][fA][mG][mC][mA][fG][mG][mA][mA][mG][mG][mUs][mGs][mG] | 1197 |
| STAT3-1813 | Modified 22 mer | Hs | [MePhosphonate-4O-mUs][fUs][fG][fA][fA][mU][fA][mA][mU][fU][mC][mA][mC][fA][mC][mC][mA][mG][mG][mUs][mGs][mG] | 1198 |

-continued

SEQUENCE LISTING

| Name | Description | Species | Sequence | SEQ ID NO |
|---|---|---|---|---|
| STAT3-1674 | Modified 22 mer | Hs | [MePhosphonate-4O-mUs][fGs][fU][fA][fA][mA][fA][mA][mA][fG][mU][mU][mU][fA][mC][mA][mU][mU][mC][mUs][mGs][mG] | 1199 |
| STAT3-1241 | Modified 22 mer | Hs | [MePhosphonate-4O-mUs][fUs][fG][fA][fC][mU][fU][mU][mA][fG][mU][mA][mG][fU][mG][mA][mA][mC][mU][mGs][mGs][mG] | 1200 |
| STAT3-1672 | Modified 22 mer | Hs | [MePhosphonate-4O-mUs][fUs][fG][fA][fC][mU][fU][mU][mA][fG][mU][mA][mG][fU][mG][mA][mA][mC][mU][mGs][mGs][mG] | 1201 |
| STAT3-0425 | Modified 22 mer | Hs | [MePhosphonate-4O-mUs][fGs][fA][fA][fC][mA][fU][mU][mC][fG][mA][mC][mU][fC][mU][mU][mG][mC][mA][mGs][mGs][mG] | 1202 |
| STAT3-1817 | Modified 22 mer | Hs | [MePhosphonate-4O-mUs][fAs][fC][fC][fC][mU][fG][mA][mA][fU][mA][mA][mU][fU][mC][mA][mC][mA][mC][mCs][mGs][mG] | 1203 |
| STAT3-1671 | Modified 22 mer | Hs | [MePhosphonate-4O-mUs][fAs][fA][fA][fA][mA][fG][mU][mU][fU][mA][mC][mA][fU][mU][mC][mU][mU][mG][mGs][mGs][mG] | 1204 |
| STAT3-2136 | Modified 22 mer | Hs-Mm | [MePhosphonate-4O-mUs][fAs][fU][fG][fU][mU][fG][mU][mU][fC][mA][mG][mC][fU][mG][mC][mU][mG][mC][mUs][mGs][mG] | 1205 |
| STAT3-2143 | Modified 22 mer | Hs-Mm | [MePhosphonate-4O-mUs][fAs][fA][fA][fU][mG][fA][mC][mA][fU][mG][mU][mU][fG][mU][mU][mC][mA][mG][mCs][mGs][mG] | 1206 |
| STAT3-2144 | Modified 22 mer | Hs-Mm | [MePhosphonate-4O-mUs][fCs][fA][fA][fA][mU][fG][mA][mC][fA][mU][mG][mU][fU][mG][mU][mU][mC][mA][mGs][mGs][mG] | 1207 |
| STAT3-2138 | Modified 22 mer | Hs-Mm | [MePhosphonate-4O-mUs][fAs][fC][fA][fU][mG][fU][mU][mG][fU][mU][mC][mA][fG][mC][mU][mG][mC][mU][mGs][mGs][mG] | 1208 |
| STAT3-4909 | Modified 22 mer | Hs-Mm | [MePhosphonate-4O-mUs][fUs][fU][fU][fA][mU][fU][mU][mC][fU][mG][mG][mA][fA][mG][mU][mU][mA][mA][mAs][mGs][mG] | 1209 |
| STAT3-2139 | Modified 22 mer | Hs-Mm | [MePhosphonate-4O-mUs][fGs][fA][fC][fA][mU][fG][mU][mU][fG][mU][mU][mC][fA][mG][mC][mU][mG][mC][mUs][mGs][mG] | 1210 |
| STAT3-2411 | Modified 22 mer | Hs-Mm | [MePhosphonate-4O-mUs][fUs][fA][fU][fU][mU][fC][mC][mA][fA][mA][mC][mU][fG][mC][mA][mU][mC][mA][mAs][mGs][mG] | 1211 |
| STAT3-2145 | Modified 22 mer | Hs-Mm | [MePhosphonate-4O-mUs][fGs][fC][fA][fA][mA][fU][mG][mA][fC][mA][mU][mG][fU][mU][mG][mU][mU][mC][mAs][mGs][mG] | 1212 |
| STAT3-4831 | Modified 22 mer | Hs-Mm | [MePhosphonate-4O-mUs][fAs][fA][fU][fA][mU][fA][mA][mA][fU][mU][mU][mU][fU][mA][mC][mA][mC][mU][mAs][mGs][mG] | 1213 |
| STAT3-2622 | Modified 22 mer | Hs-Mm | [MePhosphonate-4O-mUs][fAs][fU][fC][fU][mG][fG][mA][mA][fC][mC][mA][mC][fA][mA][mA][mG][mU][mU][mAs][mGs][mG] | 1214 |
| STAT3-2135 | Modified 22 mer | Hs-Mm | [MePhosphonate-4O-mUs][fUs][fG][fU][fU][mG][fU][mU][mC][fA][mG][mC][mU][fG][mC][mU][mG][mC][mU][mUs][mGs][mG] | 1215 |
| STAT3-1383 | Modified 22 mer | Hs-Mm | [MePhosphonate-4O-mUs][fUs][fG][fU][fU][mG][fU][mU][mC][fA][mG][mC][mU][fG][mC][mU][mG][mC][mU][mUs][mGs][mG] | 1216 |

-continued

SEQUENCE LISTING

| Name | Description | Species | Sequence | SEQ ID NO |
|---|---|---|---|---|
| NM_139276.3 human STAT3 nucleotide sequence | | | GTCGCAGCCGAGGGAACAAGCCCCAACCGGATCCTGGACA<br>GGCACCCCGGCTTGGCGCTGTCTCTCCCCCTCGGCTCGGA<br>GAGGCCCTTCGGCCTGAGGGAGCCTCGCCGCCCGTCCCCG<br>GCACACGCGCAGCCCCGGCCTCTCGGCCTCTGCCGGAGAA<br>ACAGTTGGGACCCCTGATTTTAGCAGGATGGCCCAATGGA<br>ATCAGCTACAGCAGCTTGACACACGGTACCTGGAGCAGCT<br>CCATCAGCTCTACAGTGACAGCTTCCCAATGGAGCTGCGG<br>CAGTTTCTGGCCCCTTGGATTGAGAGTCAAGATTGGGCAT<br>ATGCGGCCAGCAAAGAATCACATGCCACTTTGGTGTTTCA<br>TAATCTCCTGGGAGAGATTGACCAGCAGTATAGCCGCTTC<br>CTGCAAGAGTCGAATGTTCTCTATCAGCACAATCTACGAA<br>GAATCAAGCAGTTTCTTCAGAGCAGGTATCTTGAGAAGCC<br>AATGGAGATTGCCCGGATTGTGGCCCGGTGCCTGTGGGAA<br>GAATCACGCCTTCTACAGACTGCAGCCACTGCGGCCCAGC<br>AAGGGGGCCAGGCCAACCACCCCACAGCAGCCGTGGTGAC<br>GGAGAAGCAGCAGATGCTGGAGCAGCACCTTCAGGATGTC<br>CGGAAGAGAGTGCAGGATCTAGAACAGAAAATGAAAGTGG<br>TAGAGAATCTCCAGGATGACTTTGATTTCAACTATAAAAC<br>CCTCAAGAGTCAAGGAGACATGCAAGATCTGAATGGAAAC<br>AACCAGTCAGTGACCAGGCAGAAGATGCAGCAGCTGGAAC<br>AGATGCTCACTGCGCTGGACCAGATGCGGAGAAGCATCGT<br>GAGTGAGCTGGCGGGGCTTTTGTCAGCGATGGAGTACGTG<br>CAGAAAACTCTCACGGACGAGGAGCTGGCTGACTGGAAGA<br>GGCGGCAACAGATTGCCTGCATTGGAGGCCCGCCCAACAT<br>CTGCCTAGATCGGCTAGAAAACTGGATAACGTCATTAGCA<br>GAATCTCAACTTCAGACCCGTCAACAAATTAAGAAACTGG<br>AGGAGTTGCAGCAAAAAGTTTCCTACAAAGGGGACCCCAT<br>TGTACAGCACCGGCCGATGCTGGAGGAGAGAATCGTGGAG<br>CTGTTTAGAAACTTAATGAAAAGTGCCTTTGTGGTGGAGC<br>GGCAGCCCTGCATGCCCATGCATCCTGACCGGCCCCTCGT<br>CATCAAGACCGGCGTCCAGTTCACTACTAAAGTCAGGTTG<br>CTGGTCAAATTCCCTGAGTTGAATTATCAGCTTAAAATTA<br>AAGTGTGCATTGACAAAGACTCTGGGGACGTTGCAGCTCT<br>CAGAGGATCCCGGAAATTTAACATTCTGGGCACAAACACA<br>AAAGTGATGAACATGGAAGAATCCAACAACGGCAGCCTCT<br>CTGCAGAATTCAAACACTTGACCCTGAGGGAGCAGAGATG<br>TGGGAATGGGGGCCGAGCCAATTGTGATGCTTCCCTGATT<br>GTGACTGAGGAGCTGCACCTGATCACCTTTGAGACCGAGG<br>TGTATCACCAAGGCCTCAAGATTGACCTAGAGACCCACTC<br>CTTGCCAGTTGTGGTGATCTCCAACATCTGTCAGATGCCA<br>AATGCCTGGGCGTCCATCCTGTGGTACAACATGCTGACCA<br>ACAATCCCAAGAATGTAAACTTTTTTACCAAGCCCCCAAT<br>TGGAACCTGGGATCAAGTGGCCGAGGTCCTGAGCTGGCAG<br>TTCTCCTCCACCACCAAGCGAGGACTGAGCATCGAGCAGC<br>TGACTACACTGGCAGAGAAACTCTTGGGACCTGGTGTGAA<br>TTATTCAGGGTGTCAGATCACATGGGCTAAATTTTGCAAA<br>GAAAACATGGCTGGCAAGGGCTTCTCCTTCTGGGTCTGGC<br>TGGACAATATCATTGACCTTGTGAAAAAGTACATCCTGGC<br>CCTTTGGAACGAAGGGTACATCATGGGCTTTATCAGTAAG<br>GAGCGGGAGCGGGCCATCTTGAGCACTAAGCCTCCAGGCA<br>CCTTCCTGCTAAGATTCAGTGAAAGCAGCAAAGAAGGAGG<br>CGTCACTTTCACTTGGGTGGAGAAGGACATCAGCGGTAAG<br>ACCCAGATCCAGTCCGTGGAACCATACACAAAGCAGCAGC<br>TGAACAACATGTCATTTGCTGAAATCATCATGGGCTATAA<br>GATCATGGATGCTACCAATATCCTGGTGTCTCCACTGGTC<br>TATCTCTATCCTGACATTCCCAAGGAGGAGGCATTCGGAA<br>AGTATTGTCGGCCAGAGAGCCAGGAGCATCCTGAAGCTGA<br>CCCAGGTAGCGCTGCCCCATACCTGAAGACCAAGTTTATC<br>TGTGTGACACCAACGACCTGCAGCAATACCATTGACCTGC<br>CGATGTCCCCCCGCACTTTAGATTCATTGATGCAGTTTGG<br>AAATAATGGTGAAGGTGCTGAACCCTCAGCAGGAGGGCAG<br>TTTGAGTCCCTCACCTTTGACATGGAGTTGACCTCGGAGT<br>GCGCTACCTCCCCCATGTGAGGAGCTGAGAACGGAAGCTG<br>CAGAAAGATACGACTGAGGCGCCTACCTGCATTCTGCCAC<br>CCCTCACACAGCCAAACCCCAGATCATCTGAAACTACTAA<br>CTTTGTGGTTCCAGATTTTTTTTAATCTCCTACTTCTGCT<br>ATCTTTGAGCAATCTGGGCACTTTTAAAAATAGAGAAATG<br>AGTGAATGTGGGTGATCTGCTTTTATCTAAATGCAAATAA<br>GGATGTGTTCTCTGAGACCCATGATCAGGGGATGTGGCGG<br>GGGGTGGCTAGAGGGAGAAAAAGGAAATGTCTTGTGTTGT<br>TTTGTTCCCCTGCCCTCCTTTCTCAGCAGCTTTTTGTTAT<br>TGTTGTTGTTGTTCTTAGACAAGTGCCTCCTGGTGCCTGC<br>GGCATCCTTCTGCCTGTTTCTGTAAGCAAATGCCACAGGC | 1217 |

-continued

SEQUENCE LISTING

| Name | Description | Species | Sequence | SEQ ID NO |
|---|---|---|---|---|
| | | | CACCTATAGCTACATACTCCTGGCATTGCACTTTTTAACC TTGCTGACATCCAAATAGAAGATAGGACTATCTAAGCCCT AGGTTTCTTTTTAAATTAAGAAATAATAACAATTAAAGGG CAAAAAACACTGTATCAGCATAGCCTTTCTGTATTTAAGA AACTTAAGCAGCCGGGCATGGTGGCTCACGCCTGTAATCC CAGCACTTTGGGAGGCCGAGGCGGATCATAAGGTCAGGAG ATCAAGACCATCCTGGCTAACACGGTGAAACCCCGTCTCT ACTAAAAGTACAAAAAATTAGCTGGGTGTGGTGGTGGGCG CCTGTAGTCCCAGCTACTCGGGAGGCTGAGGCAGGAGAAT CGCTTGAACCTGAGAGGCGGAGGTTGCAGTGAGCCAAAAT TGCACCACTGCACACTGCACTCCATCCTGGGCGACAGTCT GAGACTCTGTCTCAAAAAAAAAAAAAAAAAAAAAGAAACTT CAGTTAACAGCCTCCTTGGTGCTTTAAGCATTCAGCTTCC TTCAGGCTGGTAATTTATATAATCCCTGAAACGGGCTTCA GGTCAAACCCTTAAGACATCTGAAGCTGCAACCTGGCCTT TGGTGTTGAAATAGGAAGGTTTAAGGAGAATCTAAGCATT TTAGACTTTTTTTTATAAATAGACTTATTTTCCTTTGTAA TGTATTGGCCTTTTAGTGAGTAAGGCTGGGCAGAGGGTGC TTACAACCTTGACTCCCTTTCTCCCTGGACTTGATCTGCT GTTTCAGAGGCTAGGTTGTTTCTGTGGGTGCCTTATCAGG GCTGGGATACTTCTGATTCTGGCTTCCTTCCTGCCCCACC CTCCCGACCCCAGTCCCCCTGATCCTGCTAGAGGCATGTC TCCTTGCGTGTCTAAAGGTCCCTCATCCTGTTTGTTTTAG GAATCCTGGTCTCAGGACCTCATGGAAGAAGAGGGGGAGA GAGTTACAGGTTGGACATGATGCACACTATGGGGCCCCAG CGACGTGTCTGGTTGAGCTCAGGGAATATGGTTCTTAGCC AGTTTCTTGGTGATATCCAGTGGCACTTGTAATGGCGTCT TCATTCAGTTCATGCAGGGCAAAGGCTTACTGATAAACTT GAGTCTGCCCTCGTATGAGGGTGTATACCTGGCCTCCCTC TGAGGCTGGTGACTCCTCCCTGCTGGGGCCCCACAGGTGA GGCAGAACAGCTAGAGGGCCTCCCCGCCTGCCCGCCTTGG CTGGCTAGCTCGCCTCTCCTGTGCGTATGGGAACACCTAG CACGTGCTGGATGGGCTGCCTCTGACTCAGAGGCATGGCC GGATTTGGCAACTCAAAACCACCTTGCCTCAGCTGATCAG AGTTTCTGTGGAATTCTGTTTGTTAAATCAAATTAGCTGG TCTCTGAATTAAGGGGGAGACGACCTTCTCTAAGATGAAC AGGGTTCGCCCCAGTCCTCCTGCCTGGAGACAGTTGATGT GTCATGCAGAGCTCTTACTTCTCCAGCAACACTCTTCAGT ACATAATAAGCTTAACTGATAAACAGAATATTTAGAAAGG TGAGACTTGGGCTTACCATTGGGTTTAAATCATAGGGACC TAGGGCGAGGGTTCAGGGCTTCTCTGGAGCAGATATTGTC AAGTTCATGGCCTTAGGTAGCATGTATCTGGTCTTAACTC TGATTGTAGCAAAAGTTCTGAGAGGAGCTGAGCCCTGTTG TGGCCCATTAAAGAACAGGGTCCTCAGGCCCTGCCCGCTT CCTGTCCACTGCCCCCTCCCCATCCCCAGCCCAGCCGAGG GAATCCCGTGGGTTGCTTACCTACCTATAAGGTGGTTTAT AAGCTGCTGTCCTGGCCACTGCATTCAAATTCCAATGTGT ACTTCATAGTGTAAAAATTTATATTATTGTGAGGTTTTTT GTCTTTTTTTTTTTTTTTTTTTTTTGGTATATTGCTGTAT CTACTTTAACTTCCAGAAATAAACGTTATATAGGAACCGT C | |
| XM_005584240.2 Non-human primate STAT3 nucleotide sequence | | | TGCATGACGGCGTGCCTCGGCCAGGCTGGGGCTGGGGGGG ATTGGCTGAAGGGGCTGTAATTCAGCGGTTTCCGGAGCTG CGGCGGCGTAGACCGGGAGGGGGAGCCGGGGGTTCCGACG TAGCAGCCGAGGGAACAAGCCCCAACCGGATCCTGGACAG GCACCCCGGCTCGGCGCTGTCTCTCCCCCTCGGCTCGGAT AAGCCCTCCGGCCTGAGGGAGCCCCGTCGCCCGCCCCCGG CGCACGCGCAGCCCCGGCCTCTCGGCCTCTGCTGGAGAAA CAGCAGGATGGCCCAATGGAATCAGCTACAGCAGCTTGAC ACACGGTACCTGGAGCAGCTCCATCAGCTCTACAGTGACA GCTTCCCAATGGAGTTGCGGCAGTTTCTGGCCCCTTGGAT TGAGAGTCAAGATTGGGCATATGCGGCCAGCAAAGAATCA CATGCCACTTTGGTGTTTCATAATCTCCTGGGCGAGATTG ACCAGCAGTATAGCCGCTTCCTGCAAGAATCGAATGTTCT CTATCAGCACAATCTACGAAGAATCAAGCAGTTTCTTCAG AGCAGGTATCTTGAGAAGCCAATGGAGATTGCCCGGATTG TGGCCCGGTGCCTGTGGGAAGAGTCACGCCTCCTACAGAC TGCAGCCACTGCGGCCCAGCAAGGGGGCCAGGCCAACCAC CCCACAGCAGCTGTGGTGACGGAGAAGCAGCAGATGCTGG AGCAGCACCTTCAGGATGTCCGGAAGAGAGTACAGGATCT AGAACAGAAAATGAAAGTGGTAGAGAATCTCCAGGATGAC TTTGATTTCAACTATAAAACCCTCAAGAGTCAAGGAGACA | 1218 |

-continued

SEQUENCE LISTING

| Name | Description | Species | Sequence | SEQ ID NO |
|---|---|---|---|---|
| | | | TGCAAGATCTGAATGGAAACAACCAGTCAGTGACCAGGCA<br>GAAGATGCAGCAGCTGGAACAGATGCTCACTGCGCTGGAC<br>CAGATGCGGAGAAGCATCGTGAGTGAGCTGGCGGGGCTTT<br>TGTCAGCGATGGAGTACGTGCAGAAAACTCTCACAGACGA<br>GGAGCTGGCTGACTGGAAGAGGCGGCAACAGATTGCCTGC<br>ATTGGAGGTCCGCCCAACATCTGCCTAGATCGGCTAGAAA<br>ACTGGATAACGTCATTAGCAGAATCTCAACTTCAGACCCG<br>TCAACAAATTAAGAAACTGGAGGAGTTGCAGCAAAAAGTG<br>TCCTACAAAGGGGACCCCATTGTACAGCACCGGCCGATGC<br>TGGAGGAGAGAATCGTGGAGCTGTTCAGAAACTTAATGAA<br>AAGTGCCTTTGTGGTGGAGCGGCAGCCCTGCATGCCCATG<br>CATCCCGACCGGCCCCTTGTCATCAAGACCGGCGTCCAGT<br>TCACTACCAAAGTCAGGTTGCTGGTCAAATTCCCTGAGTT<br>AAATTATCAACTTAAAATTAAAGTGTGCATTGACAAAGAC<br>TCTGGGGATGTTGCAGCTCTCAGAGGATCCCGGAAATTTA<br>ACATTCTGGGCACAAACACCAAAGTGATGAACATGGAAGA<br>GTCCAACAACGGCAGCCTCTCTGCAGAATTCAAACACTTG<br>ACCCTGAGGGAGCAGAGATGTGGGAATGGGGGCCGAGCCA<br>ATTGTGATGCTTCCCTGATTGTGACTGAGGAGCTGCACCT<br>GATCACCTTTGAGACAGAGGTATATCACCAAGGCCTCAAG<br>ATTGACCTAGAGACCCACTCCTTGCCAGTTGTGGTGATCT<br>CCAACATCTGTCAGATGCCAAATGCCTGGGCGTCCATCCT<br>GTGGTACAACATGCTGACCAACAACCCCAAGAACGTAAAC<br>TTTTTTACCAAGCCCCCAATCGGAACCTGGGATCAAGTGG<br>CCGAGGTCCTGAGCTGGCAGTTCTCCTCCACCACCAAGCG<br>AGGACTGAGCATCGAGCAGCTGACTACACTGGCGGAGAAA<br>CTCTTGGGACCTGGCGTGAATTATTCAGGGTGTCAGATCA<br>CATGGGCTAAATTTTGCAAAGAAAACATGGCTGGCAAGGG<br>CTTCTCCTTCTGGGTCTGGCTGGACAATATCATTGACCTT<br>GTGAAAAAGTACATCCTGGCCCTTTGGAATGAAGGGTACA<br>TCATGGGCTTTATCAGTAAGGAGCGGGAGCGGGCCATCTT<br>GAGCACCAAGCCTCCAGGCACCTTTCTGCTAAGATTCAGT<br>GAAAGCAGCAAAGAAGGCGGCGTCACTTTCACTTGGGTGG<br>AGAAGGACATCAGTGGTAAGACCCAGATCCAGTCCGTGGA<br>ACCATACACCAAGCAGCAGTTGAACAACATGTCATTTGCT<br>GAAATCATCATGGGCTATAAGATCATGGATGCTACCAATA<br>TTCTGGTGTCTCCGCTGGTCTATCTCTACCCTGACATTCC<br>CAAGGAGGAGGCATTCGGAAAGTATTGTCGGCCAGAGAGC<br>CAGGAGCATCCTGAAGCTGACCCAGGCGCCGCCCCATACC<br>TGAAGACCAAGTTTATCTGTGTGACACCATTCATTGATGC<br>AGTTTGGAAATAATGGTGAAGGTGCTGAACCCTCAGCAGG<br>AGGGCAGTTTGAGTCCCTCACCTTTGACATGGAGTTGACC<br>TCGGAGTGTGCTACCTCCCCCATGTGAGGAGCTGAGAACG<br>GAAGCTGCAAAAGATACGACTGAGGCGCCTACCTGTGTTC<br>CGCCACCCCTCACACAGCCAAACCCCAGATCATCTGAAAC<br>TACTAACTTTGTGGTTCCAGATTTTTTTAATCTCCTACT<br>TCTGCTATCTTTGAGCAATCTGGGCACTTTTAAAAATAAG<br>AGAAATGAGTGAATGTGGGTGATCTGCTTTTATCTAAATG<br>CAAATAAGGATGTGTTCTCTGAGACCCGTGATGGGGGGAT<br>GTGGCGGGGGGTGGCTAGAGGGAGAAAAAGGAAATGTCTT<br>GTGTTGTTTTGTTCCCCTGCCCTCCTTTCTCAGCAGCTTT<br>TTGTTATTGTTGTTGTTGTTCTTAGACAAGTGCCTCCTGG<br>TGCCCGCGGCATCCTTCTGCCTGTTTCTGTAAGCAAATGC<br>CACAGGCCACCTGTAGCTACATACTCCTGGCATTGCACTT<br>TTTAACCTTGCTGACATCCAAATAGAAGATAGGACTATCT<br>GAGCCCTAGGTTTCTTTTTAAATTAAGAAATAAGAACAAT<br>TAAAGGGCAAAAAACACTGTTTCAGCATAGCCTTTCTGTA<br>TTTAAGAAACTTCAGCAGCCGGCCGCAGGGACTCACGCCT<br>GTAATCCCAGCACTTTGGGAGGCCGAGGTGGGTGGATCAT<br>GAGGTTAGGAGATCAAGACTGTCCTGGCTAACATGGTGAA<br>ACCCCGTCTCTACTAACAGTACAAAAAATTAGCCGGGCGT<br>GGTGGTGGGTGCCTGTAGTCCCAGCTACTCGGGAGGCTGA<br>GGCAGGAGAATGGCATGAACCCAAGAGGCGGAGGTTGCAG<br>TGAGCCAAAATCACACCACTGCACTCCAACTCAGGCAACA<br>GTGTGAGACTCCATCTCAAAAAAAAAAGAAAAGAAAAAGA<br>AACTTCAGTTAACAGCCTCCTTGGTGCTTTAAGCATTCAG<br>CTTCCTTCAGGTTGATAATTTATATAACCCCTGAAACAGG<br>CTTCAGGTCAAACCCTTAAAAGACGTCTGAAGCTGCAGCC<br>TGGCCTTTGATGTTGAAATAGGAAGGTTTAAGGAGAATCT<br>AAGCATTTTAGACTTTTTTTTATAAATAGACTTCTATTTT<br>CCTTTGTAATGTATTGGTCTTTTAGTGGGTAAGGCTGGGC<br>AGAGGGTGCTTACAACCTTGACTCCCTTTCTCCCTGGACT<br>TGATCTGCTGTTTCAGAGGCTAGGTTGTTTCTGTGGGTGC | |

-continued

SEQUENCE LISTING

| Name | Description | Species | Sequence | SEQ ID NO |
|---|---|---|---|---|
| | | | CTTATCAGGGCTGGGATACTTCTGATTTGGGCTTCCTTCT<br>TGCCCCACCCTCCCGACCCCAGTTCCCCTGACCCTGCTAG<br>TGGCATGTCTCCTCCCATGTCTGAAGGTCCCTCGTCCTGT<br>TTGTTTTAGGAATCCTGGTCTCAGGACCTCATGGAAGAAG<br>AGGGGGAGAAAGTTACCAGTTGGATATGATGCAGACTATG<br>GGGCCCCAGCGACGTGTCTGGTTGAGCTCAGGGAATATGG<br>TTCTTAGCCCAGTTTCTTGGTGATTTCCAGCGGTCAGTTC<br>AGGCAGGGCAAAGGCTTACTGATAAACTTGAGTCTGCCCT<br>CGTATGAGGGTTATAGCTGGCCTCCCTCTGAGGCTGGTGA<br>CTCTTCCCTGCTGGGGCCCCACAGGTGAGACAGAACAGGT<br>AGAGGGCCTCCCTGTCTGCCCGCCTTGGCCAGCTAGCTTG<br>CCTCTCCTGTGCGTATGGGAACACCTAGCACGTGCTGGGT<br>GGGCTGCCTCTGACCCAGAGGCATGGCCGAATTTGGCGAC<br>TCAAAACCACCTTGCCTCAGCTGATCAGAGTTTCTGTGGA<br>ATTCTGATTGTTAGATCAAATTAGCTGGCCTCTGAATTAA<br>GTGGGAGAGGACCTTCTCTAAGATGAACCGGGTTCGCCCC<br>AGTCCTCCTGCCTGGAGACAGTTGATGTGTCTTGCAGAGC<br>TCTCGCTTCCCCAGCAACACTCTTCAGTACATAATAAGCT<br>TAACTGATAAACAGAGAGAATATTTAGGAAGGTGAGTCTT<br>GGGCTTACCATTGGGTTTAAATCATAGGGACCTCGGGAAA<br>GGGTTCGGGCTTCTCTGGAGCAGATATTATGAAGTTCATG<br>GCCTTAGGTAGCATGTGTATCTGGTCTTAACTCTGATTGT<br>AGCAAAAGTTCTGAGAGGAGCTGAGCCTTGTTCTGGCCCC<br>TTAAAGAACAGGGTCCTCAGGCCCTGCCCGCTTCCTGTCC<br>ACTGCCCTCCTGCCCGTCCCCAGCCCAGCTGAGGGAATCC<br>CGTGGGTTGCTTACCTACCTATAAGGTGGTTTATAAGCTG<br>CTGTCCTGGCCACTGCATTCAAATTCCAATGTGTACTTCA<br>TAGTGTAAAAATTTATATTATTGTGGGGTTTTTTGTCTTT<br>TTTTTTTTTTTTTTTTTGGTATATTGCTGTATCTACTTTA<br>ACTTCCAGAAATAAACGTTATATAGGAACCGTC | |
| Forward 1 | | | TTGTGTTTGTGCCCAGAATG | 1219 |
| Reverse 1 | | | TCCCTGAGTTGAATTATCAGCTT | 1220 |
| Probe 1 | | | /56-FAM/ACGTCCCCA/ZEN/GAGTCTTTGTCAATGC/3<br>IABKFQ/ | 1221 |
| STAT3-1286 | Modified 36-mer | Hs | [ademAs-C18][mA][mU][mU][mA][mU][mC][fA]<br>[fG][fC][fU][mU][mA][mA][mA][mA][mU][mU]<br>[mA][mA][mG][mC][mA][mG][mC][mC][mG][mA]<br>[mA][mA][mG][mG][mC][mU][mG][mC] | 1222 |
| STAT3 mouse compound | Modified 36-mer | Mouse | [ademUs-C18][mG][mA][mC][mU][mU][mU][fG]<br>[fA][fU][fU][mU][mC][mA][mA][mC][mU][mA]<br>[mU][mA][mG][mC][mA][mG][mC][mC][mG][mA]<br>[mA][mA][mG][mG][mC][mU][mG][mC] | 1223 |

SEQUENCE LISTING (1223 sequences)

SEQ ID NO: 1 - DNA, 25 bp, synthetic construct
  source 1..25: mol_type = other DNA
gatgatttcagcaaatgacatgttg

SEQ ID NO: 2 - DNA, 21 bp, synthetic construct
  source 1..21: mol_type = other DNA
cagtgaaagcagcaaagaagg

SEQ ID NO: 3 - DNA, 24 bp, synthetic construct
  modified_base 1: mod_base = OTHER; note = 6-fluorescein amidite moiety attached
  modified_base 9..10: mod_base = OTHER; note = ZEN quencher
  modified_base 24: mod_base = OTHER; note = Iowa Black FQ moiety attached
  source 1..24: mol_type = other DNA
aggacatcagcggtaagacccaga

SEQ ID NO: 4 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-guanosine
  modified_base 6: mod_base = um
  modified_base 7: mod_base = OTHER; note = 2'-fluoro-uridine
  modified_base 8: mod_base = gm
  modified_base 9: mod_base = OTHER; note = 2'-O-methyl-adenosine
  modified_base 10: mod_base = OTHER; note = 2'-fluoro-adenosine
  modified_base 11: mod_base = OTHER; note = 2'-O-methyl-adenosine
  modified_base 12: mod_base = um
  modified_base 13: mod_base = cm
  modified_base 14: mod_base = OTHER; note = 2'-fluoro-adenosine
  modified_base 15: mod_base = OTHER; note = 2'-O-methyl-adenosine
  modified_base 16: mod_base = OTHER; note = 2'-O-methyl-adenosine
  modified_base 17: mod_base = gm
  modified_base 18: mod_base = um
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tatagttgaaatcaaagtcagg

SEQ ID NO: 5 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-uridine
  modified_base 6: mod_base = um
  modified_base 7: mod_base = OTHER; note = 2'-fluoro-uridine
  modified_base 8: mod_base = um
  modified_base 9: mod_base = OTHER; note = 2'-O-methyl-adenosine
  modified_base 10: mod_base = OTHER; note = 2'-fluoro-adenosine
  modified_base 11: mod_base = gm
  modified_base 12: mod_base = cm
  modified_base 13: mod_base = um
  modified_base 14: mod_base = OTHER; note = 2'-fluoro-guanosine
  modified_base 15: mod_base = OTHER; note = 2'-O-methyl-adenosine
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttaattttaagctgataattgg

SEQ ID NO: 6 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = um
  modified_base 9: mod_base = um
  modified_base 10: mod_base = OTHER; note = 2'-fluoro-adenosine
  modified_base 11: mod_base = OTHER; note = 2'-O-methyl-adenosine
  modified_base 12: mod_base = gm
  modified_base 13: mod_base = cm
  modified_base 14: mod_base = OTHER; note = 2'-fluoro-uridine
  modified_base 15: mod_base = gm
  modified_base 16: mod_base = OTHER; note = 2'-O-methyl-adenosine
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttaattttaagctgataatgg

SEQ ID NO: 7 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-cytidine
  modified_base 6: mod_base = um
  modified_base 7: mod_base = OTHER; note = 2'-fluoro-uridine
  modified_base 8: mod_base = cm
  modified_base 9: mod_base = cm
  modified_base 10: mod_base = OTHER; note = 2'-fluoro-adenosine
  modified_base 11: mod_base = um
  modified_base 12: mod_base = gm
  modified_base 13: mod_base = um
  modified_base 14: mod_base = OTHER; note = 2'-fluoro-uridine
  modified_base 15: mod_base = cm
  modified_base 16: mod_base = OTHER; note = 2'-O-methyl-adenosine
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
tattcttccatgttcatcacgg

SEQ ID NO: 8 - DNA, 4520 bp, Mus musculus
  source 1..4520: mol_type = genomic DNA
aattatgcatggaggcgtgtcttggccagtggcggctgggtggggattggctggaggggctgtaattcagcggtttccggagctgcagtgtagacagggagggggaacctggggttccgacgtcgcggcggagggaacgagccctaaccggatcgctgaggtacaaccccgctcggtgtcgcctgaccgcgtcggctaggagaggccaggcggccctcgggagcccagcagctcgcgcctggagtcagcgcaggccggccagtcgggcctcagccccggagacagtcgagacccctgactgcagcaggatggctcagtggaaccagctgcagcagctggacacacgctacctggagcagctgcaccagctgtacagcgacagcttccccatggagctgcggcagttcctggcaccttggattgagagtcaagactgggcatatgcagccagcaaagagtcacatgccacgttggtgtttcataatctcttgggtgaaattgaccagcaatatagccgattcctgcaagagtccaatgtcctctatcagcacaaccttcgaagaatcaagcagtttctgcagagcaggtatcttgagaagccaatggaaattgcccggatcgtggcccgatgcctgtgggaagagtctcgcctcctccagacggcagccacggcagcccagcaagggggccaggccaaccacccaacagccgccgtagtgacagagaagcagcagatgttggagcagcatcttcaggatgtccggaagcgagtgcaggatctagaacagaaaatgaaggtggtggagaacctccaggacgactttgatttcaactacaaaaccctcaagagccaaggagacatgcaggatctgaatggaaacaaccagtctgtgaccagacagaagatgcagcagctggaacagatgctcacagccctggaccagatgcggagaagcattgtgagtgagctggcggggctcttgtcagcaatggagtacgtgcagaagacactgactgatgaagagctggctgactggaagaggcggcagcagatcgcgtgcatcggaggccctcccaacatctgcctggaccgtctggaaaactggataacttcattagcagaatctcaacttcagacccgccaacaaattaagaaactggaggagctgcagcagaaagtgtcctacaagggcgaccctatcgtgcagcaccggcccatgctggaggagaggatcgtggagctgttcagaaacttaatgaagagtgccttcgtggtggagcggcagccctgcatgcccatgcacccggaccggcccttagtcatcaagactggtgtccagtttaccacgaaagtcaggttgctggtcaaatttcctgagttgaattatcagcttaaaattaaagtgtgcattgataaagactctggggatgttgctgccctcagagggtctcggaaatttaacattctgggcacgaacacaaaagtgatgaacatggaggagtctaacaacggcagcctgtctgcagagttcaagcacctgacccttagggagcagagatgtgggaatggaggccgtgccaattgtgatgcctccttgatcgtgactgaggagctgcacctgatcaccttcgagactgaggtgtaccaccaaggcctcaagattgacctagagacccactccttgccagttgtggtgatctccaacatctgtcagatgccaaatgcttgggcatcaatcctgtggtataacatgctgaccaataaccccaagaacgtgaacttcttcactaagccgccaattggaacctgggaccaagtggccgaggtgctcagctggcagttctcgtccaccaccaagcgggggctgagcatcgagcagctgacaacgctggctgagaagctcctagggcctggtgtgaactactcagggtgtcagatcacatgggctaaattctgcaaagaaaacatggctggcaagggcttctccttctgggtctggctagacaatatcatcgaccttgtgaaaaagtatatcttggccctttggaatgaagggtacatcatgggtttcatcagcaaggagcgggagcgggccatcctaagcacaaagcccccgggcaccttcctactgcgcttcagcgagagcagcaaagaaggaggggtcactttcacttgggtggaaaaggacatcagtggcaagacccagatccagtctgtagagccatacaccaagcagcagctgaacaacatgtcatttgctgaaatcatcatgggctataagatcatggatgcgaccaacatcctggtgtctccacttgtctacctctaccccgacattcccaaggaggaggcatttggaaagtactgtaggcccgagagccaggagcaccccgaagccgacccaggtagtgctgccccgtacctgaagaccaagttcatctgtgtgacaccaacgacctgcagcaataccattgacctgccgatgtccccccgcactttagattcattgatgcagtttggaaataacggtgaaggtgctgagccctcagcaggagggcagtttgagtcgctcacgtttgacatggatctgacctcggagtgtgctacctcccccatgtgaggagctgaaaccagaagctgcagagacgtgacttgagacacctgccccgtgctccacccctaagcagccgaaccccatatcgtctgaaactcctaactttgtggttccagatttttttttttaatttcctacttctgctatctttgggcaatctgggcactttttaaaatagagaaatgagtgagtgtgggtgataaactgttatgtaaagaggagagcacctctgagtctggggatggggctgagagcagaagggagcaaggggaacacctcctgtcctgcccgcctgccctcctttttcagcagctcggggttggttgttagacaagtgcctcctggtgcccatggcatcctgttgccccactctgtgagctgataccccaggctgggaactcctggctctgcactttcaaccttgctaatatccacatagaagctaggactaagcccagaggttcctctttaaattaaaaaaaaaaaaaataagaattaaagggcaaaacacactgacacagcatagcctttccatatcaaggaatactcagttaacagcctctccagcgctgtcttcaggctgatcatctatataaaccctggaatggttgcagatcaaatctgtaaaagagatccgagagctgtggcttggcctctggttcaaacacaaaggctagagagaacctagatatccctgggttttgtttacccagtatgcttgtcggttggaggtgtgaggtaggccaagggcactggaaagcctttgtcatcaccctactccctccccaacccagactccagaccctgtttcagggtcagcctgccctgtgggtgccttactgggcctagggtcaacctgccttcctttcccacttgaccttgctggtagtatgtccccttcccatgtccaaaggccctctgtcctgcttctattgggaatccctgcctcaggaccttgtgtcgagagggattgccttacaggtttgaacctgcctcagactacaggccctcagcaaagctcagggagtatggtccttattctatgcgcttggttcccagggatatctgtaaccacagggcaaaagctgacatatactccaggtctgccctcatatgagtggtgtattcttggcctcccctgagactggcaactgtctgctccccattgggtctcccaggtgaggtggaacacagttcctgcacctactgtggcctccatgtcgcttgcttgcttcgctcactcagcttactggaacactgagtgttcaaggcaagcctttcctgacagaggcatggctagattcagtgactcaaagccacctcattcagctgatcagtgtctgtggaattgtttccttccagttaaccagtgtctgaattaagggcagtgaggacattgtctccaagacgaactgcttgccttgaccaccccagccttctgcttcgagacagttactgctctcccaccccatcaatgttctttagttatacaataagctgaacttataaactgaaagggtatttaggaaggcaaggcttgggcatttttatggctttcaatcctggggacccaggaacaaggtgagggcttctctggggctggtgttgtacctcaggggctctgggaagtctgtgtgcctgggttaaccacccatagtgagcccctggaactgcccactttccctctccttggccccacttggccccagcctcacccagcctgcagactgcttagcctttcagtgcagtggcttgtgttctggccactgcactcagattccaatgtaaactttctagtgtaaaaatttatattattgtgggttgttttttgttgttgtttgtttttgtatattgctgtaactactttaacttccagaaataaagattatataggaactgtctggc

SEQ ID NO: 9 - RNA, 36 nt, synthetic construct
  source 1..36: mol_type = other RNA
aggacgactttgatttcaaagcagccgaaaggctgc

SEQ ID NO: 10 - RNA, 22 nt, synthetic construct
  source 1..22: mol_type = other RNA
tttgaaatcaaagtcgtcctgg

SEQ ID NO: 11 - RNA, 36 nt, synthetic construct; identical to SEQ ID NO: 9
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = gm
  modified_base 4: mod_base = OTHER; note = 2'-O-methyl-adenosine
  modified_base 5: mod_base = cm
  modified_base 6: mod_base = gm
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-uridine
  modified_base 12: mod_base = gm
  modified_base 13: mod_base = OTHER; note = 2'-O-methyl-adenosine
  modified_base 14: mod_base = um
  modified_base 15: mod_base = um
  modified_base 16: mod_base = um
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 12 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-guanosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-adenosine
  modified_base 8: mod_base = um
  modified_base 9: mod_base = cm
  modified_base 10: mod_base = OTHER; note = 2'-fluoro-adenosine
  modified_base 11: mod_base = OTHER; note = 2'-O-methyl-adenosine
  modified_base 12: mod_base = OTHER; note = 2'-O-methyl-adenosine
  modified_base 13: mod_base = gm
  modified_base 14: mod_base = OTHER; note = 2'-fluoro-uridine
  modified_base 15: mod_base = cm
  modified_base 16: mod_base = gm
  modified_base 17: mod_base = um
  modified_base 18: mod_base = cm
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttgaaatcaaagtcgtcctgg

SEQ ID NO: 13 - RNA, 36 nt, synthetic construct
  source 1..36: mol_type = other RNA
tcaaatttcctgagttgaaagcagccgaaaggctgc

SEQ ID NO: 14 - RNA, 21 nt, synthetic construct
  source 1..21: mol_type = other RNA
tttcaactcaggaatttgagg

SEQ ID NO: 15 - RNA, 36 nt, synthetic construct; identical to SEQ ID NO: 13
  modified_base 1^2: mod_base = OTHER; note = linked via phosphorothioate
  modified_base 1: mod_base = um
  modified_base 2: mod_base = cm
  modified_base 3: mod_base = OTHER; note = 2'-O-methyl-adenosine
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = um
  modified_base 8: mod_base = OTHER; note = 2'-fluoro-uridine
  modified_base 9: mod_base = OTHER; note = 2'-fluoro-cytidine
  modified_base 10: mod_base = OTHER; note = 2'-fluoro-cytidine
  modified_base 11: mod_base = OTHER; note = 2'-fluoro-uridine
  modified_base 12: mod_base = gm
  modified_base 13: mod_base = OTHER; note = 2'-O-methyl-adenosine
  modified_base 14: mod_base = gm
  modified_base 15: mod_base = um
  modified_base 16: mod_base = um
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 16 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-cytidine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-cytidine
  modified_base 8: mod_base = um
  modified_base 9: mod_base = cm
  modified_base 10: mod_base = OTHER; note = 2'-fluoro-adenosine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-fluoro-adenosine
  modified_base 15: mod_base = OTHER; note = 2'-O-methyl-adenosine
  modified_base 16: mod_base = um
  modified_base 17: mod_base = um
  modified_base 18: mod_base = um
  modified_base 19: mod_base = gm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tttcaactcaggaaatttgagg

SEQ ID NO: 17 - RNA, 36 nt, synthetic construct
  source 1..36: mol_type = other RNA
atttcctgagttgaattatagcagccgaaaggctgc

SEQ ID NO: 18 - RNA, 22 nt, synthetic construct
  source 1..22: mol_type = other RNA
tataattcaactcaggaaatgg

SEQ ID NO: 19 - RNA, 36 nt, synthetic construct; identical to SEQ ID NO: 17
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = um
  modified_base 4: mod_base = um
  modified_base 5: mod_base = cm
  modified_base 6: mod_base = cm
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-guanosine
  modified_base 11: mod_base = OTHER; note = 2'-fluoro-uridine
  modified_base 12: mod_base = um
  modified_base 13: mod_base = gm
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 20 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = cm
  modified_base 9: mod_base = OTHER; note = 2'-O-methyl-adenosine
  modified_base 10: mod_base = OTHER; note = 2'-fluoro-adenosine
  modified_base 11: mod_base = cm
  modified_base 12: mod_base = um
  modified_base 13: mod_base = cm
  modified_base 14: mod_base = OTHER; note = 2'-fluoro-adenosine
  modified_base 15: mod_base = gm
  modified_base 16: mod_base = gm
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tataattcaactcaggaaatgg

SEQ ID NO: 21 - RNA, 36 nt, synthetic construct
  source 1..36: mol_type = other RNA
cctgagttgaattatcagcagcagccgaaaggctgc

SEQ ID NO: 22 - RNA, 22 nt, synthetic construct
  source 1..22: mol_type = other RNA
tgctgataattcaactcagggg

SEQ ID NO: 23 - RNA, 36 nt, synthetic construct; identical to SEQ ID NO: 21
  modified_base 1^2: mod_base = OTHER; note = linked via phosphorothioate
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyl-adenosine
  modified_base 6: mod_base = gm
  modified_base 7: mod_base = um
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-adenosine
  modified_base 11: mod_base = OTHER; note = 2'-fluoro-adenosine
  modified_base 12: mod_base = um
  modified_base 13: mod_base = um
  modified_base 14: mod_base = OTHER; note = 2'-O-methyl-adenosine
  modified_base 15: mod_base = um
  modified_base 16: mod_base = cm
  modified_base 17: mod_base = OTHER; note = 2'-O-methyl-adenosine
  modified_base 18: mod_base = gm
  modified_base 19: mod_base = cm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 24 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-guanosine
  modified_base 3: mod_base = OTHER; note = 2'-fluoro-cytidine
  modified_base 4: mod_base = OTHER; note = 2'-fluoro-uridine
  modified_base 5: mod_base = OTHER; note = 2'-fluoro-guanosine
  modified_base 6: mod_base = OTHER; note = 2'-O-methyl-adenosine
  modified_base 7: mod_base = OTHER; note = 2'-fluoro-uridine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-uridine
  modified_base 11: mod_base = um
  modified_base 12: mod_base = cm
  modified_base 13: mod_base = OTHER; note = 2'-O-methyl-adenosine
  modified_base 14: mod_base = OTHER; note = 2'-fluoro-adenosine
  modified_base 15: mod_base = cm
  modified_base 16: mod_base = um
  modified_base 17: mod_base = cm
  modified_base 18: mod_base = OTHER; note = 2'-O-methyl-adenosine
  modified_base 19: mod_base = gm
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tgctgataattcaactcagggg

SEQ ID NO: 25 - RNA, 36 nt, synthetic construct
  source 1..36: mol_type = other RNA
ctgagttgaattatcagctagcagccgaaaggctgc

SEQ ID NO: 26 - RNA, 22 nt, synthetic construct
  source 1..22: mol_type = other RNA
tagctgataattcaactcaggg

SEQ ID NO: 27 - RNA, 36 nt, synthetic construct; identical to SEQ ID NO: 25
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = OTHER; note = 2'-O-methyl-adenosine
  modified_base 5: mod_base = gm
  modified_base 6: mod_base = um
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = um
  modified_base 13: mod_base = OTHER; note = 2'-O-methyl-adenosine
  modified_base 14: mod_base = um
  modified_base 15: mod_base = cm
  modified_base 16: mod_base = OTHER; note = 2'-O-methyl-adenosine
  modified_base 17: mod_base = gm
  modified_base 18: mod_base = cm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 28 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-guanosine
  modified_base 4: mod_base = OTHER; note = 2'-fluoro-cytidine
  modified_base 5: mod_base = OTHER; note = 2'-fluoro-uridine
  modified_base 6: mod_base = gm
  modified_base 7: mod_base = OTHER; note = 2'-fluoro-adenosine
  modified_base 8: mod_base = um
  modified_base 9: mod_base = OTHER; note = 2'-O-methyl-adenosine
  modified_base 10: mod_base = OTHER; note = 2'-fluoro-adenosine
  modified_base 11: mod_base = um
  modified_base 12: mod_base = um
  modified_base 13: mod_base = cm
  modified_base 14: mod_base = OTHER; note = 2'-fluoro-adenosine
  modified_base 15: mod_base = OTHER; note = 2'-O-methyl-adenosine
  modified_base 16: mod_base = cm
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tagctgataattcaactcaggg

SEQ ID NO: 29 - RNA, 36 nt, synthetic construct
  source 1..36: mol_type = other RNA
tgagttgaattatcagcttagcagccgaaaggctgc

SEQ ID NO: 30 - RNA, 22 nt, synthetic construct
  source 1..22: mol_type = other RNA
taagctgataattcaactcagg

SEQ ID NO: 31 - RNA, 36 nt, synthetic construct; identical to SEQ ID NO: 29
  modified_base 1^2: mod_base = OTHER; note = linked via phosphorothioate
  modified_base 1: mod_base = um
  modified_base 2: mod_base = gm
  modified_base 3: mod_base = OTHER; note = 2'-O-methyl-adenosine
  modified_base 4: mod_base = gm
  modified_base 5: mod_base = um
  modified_base 6: mod_base = um
  modified_base 7: mod_base = gm
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-uridine
  modified_base 12: mod_base = OTHER; note = 2'-O-methyl-adenosine
  modified_base 13: mod_base = um
  modified_base 14: mod_base = cm
  modified_base 15: mod_base = OTHER; note = 2'-O-methyl-adenosine
  modified_base 16: mod_base = gm
  modified_base 17: mod_base = cm
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 32 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-guanosine
  modified_base 5: mod_base = OTHER; note = 2'-fluoro-cytidine
  modified_base 6: mod_base = um
  modified_base 7: mod_base = OTHER; note = 2'-fluoro-guanosine
  modified_base 8: mod_base = OTHER; note = 2'-O-methyl-adenosine
  modified_base 9: mod_base = um
  modified_base 10: mod_base = OTHER; note = 2'-fluoro-adenosine
  modified_base 11: mod_base = OTHER; note = 2'-O-methyl-adenosine
  modified_base 12: mod_base = um
  modified_base 13: mod_base = um
  modified_base 14: mod_base = OTHER; note = 2'-fluoro-cytidine
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = um
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
taagctgataattcaactcagg

SEQ ID NO: 33 - RNA, 36 nt, synthetic construct
  source 1..36: mol_type = other RNA
gagttgaattatcagcttaagcagccgaaaggctgc

SEQ ID NO: 34 - RNA, 22 nt, synthetic construct
  source 1..22: mol_type = other RNA
ttaagctgataattcaactcgg

SEQ ID NO: 35 - RNA, 36 nt, synthetic construct; identical to SEQ ID NO: 33
  modified_base 1^2: mod_base = OTHER; note = linked via phosphorothioate
  modified_base 1: mod_base = gm
  modified_base 2: mod_base = OTHER; note = 2'-O-methyl-adenosine
  modified_base 3: mod_base = gm
  modified_base 4: mod_base = um
  modified_base 5: mod_base = um
  modified_base 6: mod_base = gm
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-adenosine
  modified_base 12: mod_base = um
  modified_base 13: mod_base = cm
  modified_base 14: mod_base = OTHER; note = 2'-O-methyl-adenosine
  modified_base 15: mod_base = gm
  modified_base 16: mod_base = cm
  modified_base 17: mod_base = um
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 36 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-guanosine
  modified_base 6: mod_base = cm
  modified_base 7: mod_base = OTHER; note = 2'-fluoro-uridine
  modified_base 8: mod_base = gm
  modified_base 9: mod_base = OTHER; note = 2'-O-methyl-adenosine
  modified_base 10: mod_base = OTHER; note = 2'-fluoro-uridine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-fluoro-uridine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = um
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
ttaagctgataattcaactcgg

SEQ ID NO: 37 - RNA, 36 nt, synthetic construct
  source 1..36: mol_type = other RNA
agttgaattatcagcttaaagcagccgaaaggctgc

SEQ ID NO: 38 - RNA, 22 nt, synthetic construct
  source 1..22: mol_type = other RNA
tttaagctgataattcaactgg

SEQ ID NO: 39 - RNA, 36 nt, synthetic construct; identical to SEQ ID NO: 37
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = um
  modified_base 5: mod_base = gm
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-adenosine
  modified_base 11: mod_base = OTHER; note = 2'-fluoro-uridine
  modified_base 12: mod_base = cm
  modified_base 13: mod_base = OTHER; note = 2'-O-methyl-adenosine
  modified_base 14: mod_base = gm
  modified_base 15: mod_base = cm
  modified_base 16: mod_base = um
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 40 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = gm
  modified_base 7: mod_base = OTHER; note = 2'-fluoro-cytidine
  modified_base 8: mod_base = um
  modified_base 9: mod_base = gm
  modified_base 10: mod_base = OTHER; note = 2'-fluoro-adenosine
  modified_base 11: mod_base = um
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-uridine
  modified_base 15: mod_base = um
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttaagctgataattcaactgg

SEQ ID NO: 41 - RNA, 36 nt, synthetic construct
  source 1..36: mol_type = other RNA
caatcctgtggtataacatagcagccgaaaggctgc

SEQ ID NO: 42 - RNA, 22 nt, synthetic construct
  source 1..22: mol_type = other RNA
tatgttataccacaggattggg

SEQ ID NO: 43 - RNA, 36 nt, synthetic construct; identical to SEQ ID NO: 41
  modified_base 1^2: mod_base = OTHER; note = linked via phosphorothioate
  modified_base 1: mod_base = cm
  modified_base 2: mod_base = OTHER; note = 2'-O-methyl-adenosine
  modified_base 3: mod_base = OTHER; note = 2'-O-methyl-adenosine
  modified_base 4: mod_base = um
  modified_base 5: mod_base = cm
  modified_base 6: mod_base = cm
  modified_base 7: mod_base = um
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-guanosine
  modified_base 12: mod_base = um
  modified_base 13: mod_base = OTHER; note = 2'-O-methyl-adenosine
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 44 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-guanosine
  modified_base 5: mod_base = OTHER; note = 2'-fluoro-uridine
  modified_base 6: mod_base = um
  modified_base 7: mod_base = OTHER; note = 2'-fluoro-adenosine
  modified_base 8: mod_base = um
  modified_base 9: mod_base = OTHER; note = 2'-O-methyl-adenosine
  modified_base 10: mod_base = OTHER; note = 2'-fluoro-cytidine
  modified_base 11: mod_base = cm
  modified_base 12: mod_base = OTHER; note = 2'-O-methyl-adenosine
  modified_base 13: mod_base = cm
  modified_base 14: mod_base = OTHER; note = 2'-fluoro-adenosine
  modified_base 15: mod_base = gm
  modified_base 16: mod_base = gm
  modified_base 17: mod_base = OTHER; note = 2'-O-methyl-adenosine
  modified_base 18: mod_base = um
  modified_base 19: mod_base = um
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tatgttataccacaggattggg

SEQ ID NO: 45 - RNA, 36 nt, synthetic construct
  source 1..36: mol_type = other RNA
acaatatcatcgaccttgtagcagccgaaaggctgc

SEQ ID NO: 46 - RNA, 22 nt, synthetic construct
  source 1..22: mol_type = other RNA
tacaaggtcgatgatattgtgg

SEQ ID NO: 47 - RNA, 36 nt, synthetic construct; identical to SEQ ID NO: 45
  modified_base 1^2: mod_base = OTHER; note = linked via phosphorothioate
  modified_base 1: mod_base = OTHER; note = 2'-O-methyl-adenosine
  modified_base 2: mod_base = cm
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-O-methyl-adenosine
  modified_base 7: mod_base = um
  modified_base 8: mod_base = OTHER; note = 2'-fluoro-cytidine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-cytidine
  modified_base 12: mod_base = gm
  modified_base 13: mod_base = OTHER; note = 2'-O-methyl-adenosine
  modified_base 14: mod_base = cm
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 48 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-adenosine
  modified_base 6: mod_base = gm
  modified_base 7: mod_base = OTHER; note = 2'-fluoro-guanosine
  modified_base 8: mod_base = um
  modified_base 9: mod_base = cm
  modified_base 10: mod_base = OTHER; note = 2'-fluoro-guanosine
  modified_base 11: mod_base = OTHER; note = 2'-O-methyl-adenosine
  modified_base 12: mod_base = um
  modified_base 13: mod_base = gm
  modified_base 14: mod_base = OTHER; note = 2'-fluoro-adenosine
  modified_base 15: mod_base = um
  modified_base 16: mod_base = OTHER; note = 2'-O-methyl-adenosine
  modified_base 17: mod_base = um
  modified_base 18: mod_base = um
  modified_base 19: mod_base = gm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tacaaggtcgatgatattgtgg

SEQ ID NO: 49 - RNA, 36 nt, synthetic construct
  source 1..36: mol_type = other RNA
atcatcgaccttgtgaaaaagcagccgaaaggctgc

SEQ ID NO: 50 - RNA, 22 nt, synthetic construct
  source 1..22: mol_type = other RNA
tttttcacaaggtcgatgatgg

SEQ ID NO: 51 - RNA, 36 nt, synthetic construct; identical to SEQ ID NO: 49
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = cm
  modified_base 4: mod_base = OTHER; note = 2'-O-methyl-adenosine
  modified_base 5: mod_base = um
  modified_base 6: mod_base = cm
  modified_base 7: mod_base = gm
  modified_base 8: mod_base = OTHER; note = 2'-fluoro-adenosine
  modified_base 9: mod_base = OTHER; note = 2'-fluoro-cytidine
  modified_base 10: mod_base = OTHER; note = 2'-fluoro-cytidine
  modified_base 11: mod_base = OTHER; note = 2'-fluoro-uridine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 52 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-uridine
  modified_base 6: mod_base = cm
  modified_base 7: mod_base = OTHER; note = 2'-fluoro-adenosine
  modified_base 8: mod_base = cm
  modified_base 9: mod_base = OTHER; note = 2'-O-methyl-adenosine
  modified_base 10: mod_base = OTHER; note = 2'-fluoro-adenosine
  modified_base 11: mod_base = gm
  modified_base 12: mod_base = gm
  modified_base 13: mod_base = um
  modified_base 14: mod_base = OTHER; note = 2'-fluoro-cytidine
  modified_base 15: mod_base = gm
  modified_base 16: mod_base = OTHER; note = 2'-O-methyl-adenosine
  modified_base 17: mod_base = um
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttttcacaaggtcgatgatgg

SEQ ID NO: 53 - RNA, 36 nt, synthetic construct
  source 1..36: mol_type = other RNA
ctgaagaccaagttcatctagcagccgaaaggctgc

SEQ ID NO: 54 - RNA, 22 nt, synthetic construct
  source 1..22: mol_type = other RNA
tagatgaacttggtcttcaggg

SEQ ID NO: 55 - RNA, 36 nt, synthetic construct; identical to SEQ ID NO: 53
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = OTHER; note = 2'-O-methyl-adenosine
  modified_base 5: mod_base = OTHER; note = 2'-O-methyl-adenosine
  modified_base 6: mod_base = gm
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-cytidine
  modified_base 10: mod_base = OTHER; note = 2'-fluoro-adenosine
  modified_base 11: mod_base = OTHER; note = 2'-fluoro-adenosine
  modified_base 12: mod_base = gm
  modified_base 13: mod_base = um
  modified_base 14: mod_base = um
  modified_base 15: mod_base = cm
  modified_base 16: mod_base = OTHER; note = 2'-O-methyl-adenosine
  modified_base 17: mod_base = um
  modified_base 18: mod_base = cm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 56 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-uridine
  modified_base 6: mod_base = gm
  modified_base 7: mod_base = OTHER; note = 2'-fluoro-adenosine
  modified_base 8: mod_base = OTHER; note = 2'-O-methyl-adenosine
  modified_base 9: mod_base = cm
  modified_base 10: mod_base = OTHER; note = 2'-fluoro-uridine
  modified_base 11: mod_base = um
  modified_base 12: mod_base = gm
  modified_base 13: mod_base = gm
  modified_base 14: mod_base = OTHER; note = 2'-fluoro-uridine
  modified_base 15: mod_base = cm
  modified_base 16: mod_base = um
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tagatgaacttggtcttcaggg

SEQ ID NO: 57 - RNA, 36 nt, synthetic construct
  source 1..36: mol_type = other RNA
attcattgatgcagtttggagcagccgaaaggctgc

SEQ ID NO: 58 - RNA, 22 nt, synthetic construct
  source 1..22: mol_type = other RNA
tccaaactgcatcaatgaatgg

SEQ ID NO: 59 - RNA, 36 nt, synthetic construct; identical to SEQ ID NO: 57
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = um
  modified_base 4: mod_base = cm
  modified_base 5: mod_base = OTHER; note = 2'-O-methyl-adenosine
  modified_base 6: mod_base = um
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-guanosine
  modified_base 12: mod_base = cm
  modified_base 13: mod_base = OTHER; note = 2'-O-methyl-adenosine
  modified_base 14: mod_base = gm
  modified_base 15: mod_base = um
  modified_base 16: mod_base = um
  modified_base 17: mod_base = um
  modified_base 18: mod_base = gm
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 60 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-cytidine
  modified_base 8: mod_base = um
  modified_base 9: mod_base = gm
  modified_base 10: mod_base = OTHER; note = 2'-fluoro-cytidine
  modified_base 11: mod_base = OTHER; note = 2'-O-methyl-adenosine
  modified_base 12: mod_base = um
  modified_base 13: mod_base = cm
  modified_base 14: mod_base = OTHER; note = 2'-fluoro-adenosine
  modified_base 15: mod_base = OTHER; note = 2'-O-methyl-adenosine
  modified_base 16: mod_base = um
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tccaaactgcatcaatgaatgg

SEQ ID NO: 61 - RNA, 36 nt, synthetic construct
  source 1..36: mol_type = other RNA
cccatcaatgttctttagtagcagccgaaaggctgc

SEQ ID NO: 62 - RNA, 22 nt, synthetic construct
  source 1..22: mol_type = other RNA
tactaaagaacattgatggggg

SEQ ID NO: 63 - RNA, 36 nt, synthetic construct; identical to SEQ ID NO: 61
  modified_base 1^2: mod_base = OTHER; note = linked via phosphorothioate
  modified_base 1: mod_base = cm
  modified_base 2: mod_base = cm
  modified_base 3: mod_base = cm
  modified_base 4: mod_base = OTHER; note = 2'-O-methyl-adenosine
  modified_base 5: mod_base = um
  modified_base 6: mod_base = cm
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-uridine
  modified_base 12: mod_base = um
  modified_base 13: mod_base = cm
  modified_base 14: mod_base = um
  modified_base 15: mod_base = um
  modified_base 16: mod_base = um
  modified_base 17: mod_base = OTHER; note = 2'-O-methyl-adenosine
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 64 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-uridine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-adenosine
  modified_base 8: mod_base = gm
  modified_base 9: mod_base = OTHER; note = 2'-O-methyl-adenosine
  modified_base 10: mod_base = OTHER; note = 2'-fluoro-adenosine
  modified_base 11: mod_base = cm
  modified_base 12: mod_base = OTHER; note = 2'-O-methyl-adenosine
  modified_base 13: mod_base = um
  modified_base 14: mod_base = OTHER; note = 2'-fluoro-uridine
  modified_base 15: mod_base = gm
  modified_base 16: mod_base = OTHER; note = 2'-O-methyl-adenosine
  modified_base 17: mod_base = um
  modified_base 18: mod_base = gm
  modified_base 19: mod_base = gm
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tactaaagaacattgatggggg

SEQ ID NO: 65 - RNA, 36 nt, synthetic construct
  source 1..36: mol_type = other RNA
atcaatgttctttagttatagcagccgaaaggctgc

SEQ ID NO: 66 - RNA, 22 nt, synthetic construct
  source 1..22: mol_type = other RNA
tataactaaagaacattgatgg

SEQ ID NO: 67 - RNA, 36 nt, synthetic construct; identical to SEQ ID NO: 65
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = gm
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-cytidine
  modified_base 11: mod_base = OTHER; note = 2'-fluoro-uridine
  modified_base 12: mod_base = um
  modified_base 13: mod_base = um
  modified_base 14: mod_base = OTHER; note = 2'-O-methyl-adenosine
  modified_base 15: mod_base = gm
  modified_base 16: mod_base = um
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 68 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = cm
  modified_base 7: mod_base = OTHER; note = 2'-fluoro-uridine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-adenosine
  modified_base 11: mod_base = gm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-cytidine
  modified_base 15: mod_base = OTHER; note = 2'-O-methyl-adenosine
  modified_base 16: mod_base = um
  modified_base 17: mod_base = um
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tataactaaagaacattgatgg

SEQ ID NO: 69 - RNA, 36 nt, synthetic construct
  source 1..36: mol_type = other RNA
agttatacaataagctgaaagcagccgaaaggctgc

SEQ ID NO: 70 - RNA, 22 nt, synthetic construct
  source 1..22: mol_type = other RNA
tttcagcttattgtataactgg

SEQ ID NO: 71 - RNA, 36 nt, synthetic construct; identical to SEQ ID NO: 69
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = um
  modified_base 5: mod_base = OTHER; note = 2'-O-methyl-adenosine
  modified_base 6: mod_base = um
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = gm
  modified_base 15: mod_base = cm
  modified_base 16: mod_base = um
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 72 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-cytidine
  modified_base 5: mod_base = OTHER; note = 2'-fluoro-adenosine
  modified_base 6: mod_base = gm
  modified_base 7: mod_base = OTHER; note = 2'-fluoro-cytidine
  modified_base 8: mod_base = um
  modified_base 9: mod_base = um
  modified_base 10: mod_base = OTHER; note = 2'-fluoro-adenosine
  modified_base 11: mod_base = um
  modified_base 12: mod_base = um
  modified_base 13: mod_base = gm
  modified_base 14: mod_base = OTHER; note = 2'-fluoro-uridine
  modified_base 15: mod_base = OTHER; note = 2'-O-methyl-adenosine
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttcagcttattgtataactgg

SEQ ID NO: 73 - RNA, 36 nt, synthetic construct
  source 1..36: mol_type = other RNA
agtgtaaaaatttatattaagcagccgaaaggctgc

SEQ ID NO: 74 - RNA, 22 nt, synthetic construct
  source 1..22: mol_type = other RNA
ttaatataaatttttacactgg

SEQ ID NO: 75 - RNA, 36 nt, synthetic construct; identical to SEQ ID NO: 73
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = gm
  modified_base 5: mod_base = um
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = um
  modified_base 13: mod_base = um
  modified_base 14: mod_base = OTHER; note = 2'-O-methyl-adenosine
  modified_base 15: mod_base = um
  modified_base 16: mod_base = OTHER; note = 2'-O-methyl-adenosine
  modified_base 17: mod_base = um
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 76 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-uridine
  modified_base 6: mod_base = OTHER; note = 2'-O-methyl-adenosine
  modified_base 7: mod_base = OTHER; note = 2'-fluoro-uridine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-adenosine
  modified_base 11: mod_base = um
  modified_base 12: mod_base = um
  modified_base 13: mod_base = um
  modified_base 14: mod_base = OTHER; note = 2'-fluoro-uridine
  modified_base 15: mod_base = um
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttaatataaatttttacactgg

SEQ ID NO: 77 - RNA, 36 nt, synthetic construct
  source 1..36: mol_type = other RNA
ttgtttgtttttgtatattagcagccgaaaggctgc

SEQ ID NO: 78 - RNA, 22 nt, synthetic construct
  source 1..22: mol_type = other RNA
ttaatataaatttttacactgg

SEQ ID NO: 79 - RNA, 36 nt, synthetic construct; identical to SEQ ID NO: 77
  modified_base 1^2: mod_base = OTHER; note = linked via phosphorothioate
  modified_base 1: mod_base = um
  modified_base 2: mod_base = um
  modified_base 3: mod_base = gm
  modified_base 4: mod_base = um
  modified_base 5: mod_base = um
  modified_base 6: mod_base = um
  modified_base 7: mod_base = gm
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-uridine
  modified_base 12: mod_base = um
  modified_base 13: mod_base = gm
  modified_base 14: mod_base = um
  modified_base 15: mod_base = OTHER; note = 2'-O-methyl-adenosine
  modified_base 16: mod_base = um
  modified_base 17: mod_base = OTHER; note = 2'-O-methyl-adenosine
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 80 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-uridine
  modified_base 5: mod_base = OTHER; note = 2'-fluoro-adenosine
  modified_base 6: mod_base = um
  modified_base 7: mod_base = OTHER; note = 2'-fluoro-adenosine
  modified_base 8: mod_base = cm
  modified_base 9: mod_base = OTHER; note = 2'-O-methyl-adenosine
  modified_base 10: mod_base = OTHER; note = 2'-fluoro-adenosine
  modified_base 11: mod_base = OTHER; note = 2'-O-methyl-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-cytidine
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
taatatacaaaaacaaacaagg

SEQ ID NO: 81 - RNA, 36 nt, synthetic construct; identical to SEQ ID NO: 65
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = gm
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-cytidine
  modified_base 11: mod_base = OTHER; note = 2'-fluoro-uridine
  modified_base 12: mod_base = um
  modified_base 13: mod_base = um
  modified_base 14: mod_base = OTHER; note = 2'-O-methyl-adenosine
  modified_base 15: mod_base = gm
  modified_base 16: mod_base = um
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = octadecanamidodiethoxymethanol-adenosine
  modified_base 29: mod_base = OTHER; note = 2'-O-methyl-adenosine
  modified_base 30: mod_base = OTHER; note = 2'-O-methyl-adenosine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 82 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = cm
  modified_base 7: mod_base = OTHER; note = 2'-fluoro-uridine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-adenosine
  modified_base 11: mod_base = gm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-cytidine
  modified_base 15: mod_base = OTHER; note = 2'-O-methyl-adenosine
  modified_base 16: mod_base = um
  modified_base 17: mod_base = um
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tataactaaagaacattgatgg

SEQ ID NO: 83 - RNA, 36 nt, synthetic construct; identical to SEQ ID NO: 69
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = um
  modified_base 5: mod_base = OTHER; note = 2'-O-methyl-adenosine
  modified_base 6: mod_base = um
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = gm
  modified_base 15: mod_base = cm
  modified_base 16: mod_base = um
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = octadecanamidodiethoxymethanol-adenosine
  modified_base 29: mod_base = OTHER; note = 2'-O-methyl-adenosine
  modified_base 30: mod_base = OTHER; note = 2'-O-methyl-adenosine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 84 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-cytidine
  modified_base 5: mod_base = OTHER; note = 2'-fluoro-adenosine
  modified_base 6: mod_base = gm
  modified_base 7: mod_base = OTHER; note = 2'-fluoro-cytidine
  modified_base 8: mod_base = um
  modified_base 9: mod_base = um
  modified_base 10: mod_base = OTHER; note = 2'-fluoro-adenosine
  modified_base 11: mod_base = um
  modified_base 12: mod_base = um
  modified_base 13: mod_base = gm
  modified_base 14: mod_base = OTHER; note = 2'-fluoro-uridine
  modified_base 15: mod_base = OTHER; note = 2'-O-methyl-adenosine
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttcagcttattgtataactgg

SEQ ID NO: 85 - DNA, 4899 bp, Homo sapiens
  source 1..4899: mol_type = genomic DNA
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 86 - RNA, 16 nt, synthetic construct
  source 1..16: mol_type = other RNA
gcagccgaaaggctgc

SEQ ID NO: 87 - RNA, 36 nt, synthetic construct; identical to SEQ ID NO: 65
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = gm
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-cytidine
  modified_base 11: mod_base = OTHER; note = 2'-fluoro-uridine
  modified_base 12: mod_base = um
  modified_base 13: mod_base = um
  modified_base 14: mod_base = OTHER; note = 2'-O-methyl-adenosine
  modified_base 15: mod_base = gm
  modified_base 16: mod_base = um
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = octadecanamidodiethoxymethanol-adenosine
  modified_base 29: mod_base = OTHER; note = 2'-O-methyl-adenosine
  modified_base 30: mod_base = OTHER; note = 2'-O-methyl-adenosine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 88 - RNA, 36 nt, synthetic construct; identical to SEQ ID NO: 69
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = um
  modified_base 5: mod_base = OTHER; note = 2'-O-methyl-adenosine
  modified_base 6: mod_base = um
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = gm
  modified_base 15: mod_base = cm
  modified_base 16: mod_base = um
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = octadecanamidodiethoxymethanol-adenosine
  modified_base 29: mod_base = OTHER; note = 2'-O-methyl-adenosine
  modified_base 30: mod_base = OTHER; note = 2'-O-methyl-adenosine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 89 - RNA, 19 nt, synthetic construct
  source 1..19: mol_type = other RNA
cactttggtgtttcataat

SEQ ID NO: 90 - RNA, 19 nt, synthetic construct
  source 1..19: mol_type = other RNA
ctttggtgtttcataatct

SEQ ID NO: 91 - RNA, 19 nt, synthetic construct
  source 1..19: mol_type = other RNA
cctgcaagagtcgaatgtt

SEQ ID NO: 92 - RNA, 19 nt, synthetic construct
  source 1..19: mol_type = other RNA
ctgcaagagtcgaatgttc

SEQ ID NO: 93 - RNA, 19 nt, synthetic construct
  source 1..19: mol_type = other RNA
tgcaagagtcgaatgttct

SEQ ID NO: 94 - RNA, 19 nt, synthetic construct
  source 1..19: mol_type = other RNA
aagagtcgaatgttctcta

SEQ ID NO: 95 - RNA, 19 nt, synthetic construct
  source 1..19: mol_type = other RNA
agagtcgaatgttctctat

SEQ ID NO: 96 - RNA, 19 nt, synthetic construct
  source 1..19: mol_type = other RNA
agtcgaatgttctctatca

SEQ ID NO: 97 - RNA, 19 nt, synthetic construct
  source 1..19: mol_type = other RNA
gtcgaatgttctctatcag

SEQ ID NO: 98 - RNA, 19 nt, synthetic construct
  source 1..19: mol_type = other RNA
acgaagaatcaagcagttt

SEQ ID NO: 99 - RNA, 19 nt, synthetic construct
  source 1..19: mol_type = other RNA
cgaagaatcaagcagtttc

SEQ ID NO: 100 - RNA, 19 nt, synthetic construct
  source 1..19: mol_type = other RNA
gaagaatcaagcagtttct

SEQ ID NO: 101 - RNA, 19 nt, synthetic construct
  source 1..19: mol_type = other RNA
atcttgagaagccaatgga

SEQ ID NO: 102 - RNA, 19 nt, synthetic construct
  source 1..19: mol_type = other RNA
aggatctagaacagaaaat

SEQ ID NO: 103 - RNA, 19 nt, synthetic construct
  source 1..19: mol_type = other RNA
atctagaacagaaaatgaa

SEQ ID NO: 104 - RNA, 19 nt, synthetic construct
  source 1..19: mol_type = other RNA
ccaggatgactttgatttc

SEQ ID NO: 105 - RNA, 19 nt, synthetic construct
  source 1..19: mol_type = other RNA
caggatgactttgatttca

SEQ ID NO: 106 - RNA, 19 nt, synthetic construct
  source 1..19: mol_type = other RNA
aggatgactttgatttcaa

SEQ ID NO: 107 - RNA, 19 nt, synthetic construct
  source 1..19: mol_type = other RNA
atgactttgatttcaacta

SEQ ID NO: 108 - RNA, 19 nt, synthetic construct
  source 1..19: mol_type = other RNA
tgactttgatttcaactat

SEQ ID NO: 109 - RNA, 19 nt, synthetic construct
  source 1..19: mol_type = other RNA
gactttgatttcaactata

SEQ ID NO: 110 - RNA, 19 nt, synthetic construct
  source 1..19: mol_type = other RNA
actttgatttcaactataa

SEQ ID NO: 111 - RNA, 19 nt, synthetic construct
  source 1..19: mol_type = other RNA
ctttgatttcaactataaa

SEQ ID NO: 112 - RNA, 19 nt, synthetic construct
  source 1..19: mol_type = other RNA
aagatctgaatggaaacaa

SEQ ID NO: 113 - RNA, 19 nt, synthetic construct
  source 1..19: mol_type = other RNA
atctgaatggaaacaacca

SEQ ID NO: 114 - RNA, 19 nt, synthetic construct
  source 1..19: mol_type = other RNA
ctgaatggaaacaaccagt

SEQ ID NO: 115 - RNA, 19 nt, synthetic construct
  source 1..19: mol_type = other RNA
agaaaactggataacgtca

SEQ ID NO: 116 - RNA, 19 nt, synthetic construct
  source 1..19: mol_type = other RNA
gaaaactggataacgtcat

SEQ ID NO: 117 - RNA, 19 nt, synthetic construct
  source 1..19: mol_type = other RNA
aaactggataacgtcatta

SEQ ID NO: 118 - RNA, 19 nt, synthetic construct
  source 1..19: mol_type = other RNA
ctggataacgtcattagca

SEQ ID NO: 119 - RNA, 19 nt, synthetic construct
  source 1..19: mol_type = other RNA
ggataacgtcattagcaga

SEQ ID NO: 120 - RNA, 19 nt, synthetic construct
  source 1..19: mol_type = other RNA
gataacgtcattagcagaa

SEQ ID NO: 121 - RNA, 19 nt, synthetic construct
  source 1..19: mol_type = other RNA
ataacgtcattagcagaat

SEQ ID NO: 122 - RNA, 19 nt, synthetic construct
  source 1..19: mol_type = other RNA
aacaaattaagaaactgga

SEQ ID NO: 123 - RNA, 19 nt, synthetic construct
  source 1..19: mol_type = other RNA
gagttgcagcaaaaagttt

SEQ ID NO: 124 - RNA, 19 nt, synthetic construct
  source 1..19: mol_type = other RNA
agttgcagcaaaaagtttc

SEQ ID NO: 125 - RNA, 19 nt, synthetic construct
  source 1..19: mol_type = other RNA
ctgtttagaaacttaatga

SEQ ID NO: 126 - RNA, 19 nt, synthetic construct
  source 1..19: mol_type = other RNA
agaaacttaatgaaaagtg

SEQ ID NO: 127 - RNA, 19 nt, synthetic construct
  source 1..19: mol_type = other RNA
cagttcactactaaagtca

SEQ ID NO: 128 - RNA, 19 nt, synthetic construct
  source 1..19: mol_type = other RNA
gtcaaattccctgagttga

SEQ ID NO: 129 - RNA, 19 nt, synthetic construct
  source 1..19: mol_type = other RNA
aattccctgagttgaatta

SEQ ID NO: 130 - RNA, 19 nt, synthetic construct
  source 1..19: mol_type = other RNA
attccctgagttgaattat

SEQ ID NO: 131 - RNA, 19 nt, synthetic construct
  source 1..19: mol_type = other RNA
tccctgagttgaattatca

SEQ ID NO: 132 - RNA, 19 nt, synthetic construct
  source 1..19: mol_type = other RNA
cctgagttgaattatcagc

SEQ ID NO: 133 - RNA, 19 nt, synthetic construct
  source 1..19: mol_type = other RNA
ctgagttgaattatcagct

SEQ ID NO: 134 - RNA, 19 nt, synthetic construct
  source 1..19: mol_type = other RNA
tgagttgaattatcagctt

SEQ ID NO: 135 - RNA, 19 nt, synthetic construct
  source 1..19: mol_type = other RNA
gagttgaattatcagctta

SEQ ID NO: 136 - RNA, 19 nt, synthetic construct
  source 1..19: mol_type = other RNA
agttgaattatcagcttaa

SEQ ID NO: 137 - RNA, 19 nt, synthetic construct
  source 1..19: mol_type = other RNA
gttgaattatcagcttaaa

SEQ ID NO: 138 - RNA, 19 nt, synthetic construct
  source 1..19: mol_type = other RNA
ttgaattatcagcttaaaa

SEQ ID NO: 139 - RNA, 19 nt, synthetic construct
  source 1..19: mol_type = other RNA
tgaattatcagcttaaaat

SEQ ID NO: 140 - RNA, 19 nt, synthetic construct
  source 1..19: mol_type = other RNA
aattatcagcttaaaatta

SEQ ID NO: 141 - RNA, 19 nt, synthetic construct
  source 1..19: mol_type = other RNA
attatcagcttaaaattaa

SEQ ID NO: 142 - RNA, 19 nt, synthetic construct
  source 1..19: mol_type = other RNA
cagcttaaaattaaagtgt

SEQ ID NO: 143 - RNA, 19 nt, synthetic construct
  source 1..19: mol_type = other RNA
agcttaaaattaaagtgtg

SEQ ID NO: 144 - RNA, 19 nt, synthetic construct
  source 1..19: mol_type = other RNA
aaattaaagtgtgcattga

SEQ ID NO: 145 - RNA, 19 nt, synthetic construct
  source 1..19: mol_type = other RNA
aagtgtgcattgacaaaga

SEQ ID NO: 146 - RNA, 19 nt, synthetic construct
  source 1..19: mol_type = other RNA
caaaagtgatgaacatgga

SEQ ID NO: 147 - RNA, 19 nt, synthetic construct
  source 1..19: mol_type = other RNA
gtgatgaacatggaagaat

SEQ ID NO: 148 - RNA, 19 nt, synthetic construct
  source 1..19: mol_type = other RNA
gcagaattcaaacacttga

SEQ ID NO: 149 - RNA, 19 nt, synthetic construct
  source 1..19: mol_type = other RNA
attgtgatgcttccctgat

SEQ ID NO: 150 - RNA, 19 nt, synthetic construct
  source 1..19: mol_type = other RNA
ccttgccagttgtggtgat

SEQ ID NO: 151 - RNA, 19 nt, synthetic construct
  source 1..19: mol_type = other RNA
ttgccagttgtggtgatct

SEQ ID NO: 152 - RNA, 19 nt, synthetic construct
  source 1..19: mol_type = other RNA
cccaagaatgtaaactttt

SEQ ID NO: 153 - RNA, 19 nt, synthetic construct
  source 1..19: mol_type = other RNA
ccaagaatgtaaacttttt

SEQ ID NO: 154 - RNA, 19 nt, synthetic construct
  source 1..19: mol_type = other RNA
caagaatgtaaactttttt

SEQ ID NO: 155 - RNA, 19 nt, synthetic construct
  source 1..19: mol_type = other RNA
aagaatgtaaactttttta

SEQ ID NO: 156 - RNA, 19 nt, synthetic construct
  source 1..19: mol_type = other RNA
agaatgtaaacttttttac

SEQ ID NO: 157 - RNA, 19 nt, synthetic construct
  source 1..19: mol_type = other RNA
aatgtaaacttttttacca

SEQ ID NO: 158 - RNA, 19 nt, synthetic construct
  source 1..19: mol_type = other RNA
acctggtgtgaattattca

SEQ ID NO: 159 - RNA, 19 nt, synthetic construct
  source 1..19: mol_type = other RNA
ctggtgtgaattattcagg

SEQ ID NO: 160 - RNA, 19 nt, synthetic construct
  source 1..19: mol_type = other RNA
ggtgtgaattattcagggt

SEQ ID NO: 161 - RNA, 19 nt, synthetic construct
  source 1..19: mol_type = other RNA
tgtgaattattcagggtgt

SEQ ID NO: 162 - RNA, 19 nt, synthetic construct
  source 1..19: mol_type = other RNA
ctggacaatatcattgacc

SEQ ID NO: 163 - RNA, 19 nt, synthetic construct
  source 1..19: mol_type = other RNA
ggacaatatcattgacctt

SEQ ID NO: 164 - RNA, 19 nt, synthetic construct
  source 1..19: mol_type = other RNA
gacaatatcattgaccttg

SEQ ID NO: 165 - RNA, 19 nt, synthetic construct
  source 1..19: mol_type = other RNA
acaatatcattgaccttgt

SEQ ID NO: 166 - RNA, 19 nt, synthetic construct
  source 1..19: mol_type = other RNA
caatatcattgaccttgtg

SEQ ID NO: 167 - RNA, 19 nt, synthetic construct
  source 1..19: mol_type = other RNA
aatatcattgaccttgtga

SEQ ID NO: 168 - RNA, 19 nt, synthetic construct
  source 1..19: mol_type = other RNA
atatcattgaccttgtgaa

SEQ ID NO: 169 - RNA, 19 nt, synthetic construct
  source 1..19: mol_type = other RNA
tatcattgaccttgtgaaa

SEQ ID NO: 170 - RNA, 19 nt, synthetic construct
  source 1..19: mol_type = other RNA
atcattgaccttgtgaaaa

SEQ ID NO: 171 - RNA, 19 nt, synthetic construct
  source 1..19: mol_type = other RNA
tcattgaccttgtgaaaaa

SEQ ID NO: 172 - RNA, 19 nt, synthetic construct
  source 1..19: mol_type = other RNA
attgaccttgtgaaaaagt

SEQ ID NO: 173 - RNA, 19 nt, synthetic construct
  source 1..19: mol_type = other RNA
ttgaccttgtgaaaaagta

SEQ ID NO: 174 - RNA, 19 nt, synthetic construct
  source 1..19: mol_type = other RNA
gaccttgtgaaaaagtaca

SEQ ID NO: 175 - RNA, 19 nt, synthetic construct
  source 1..19: mol_type = other RNA
accttgtgaaaaagtacat

SEQ ID NO: 176 - RNA, 19 nt, synthetic construct
  source 1..19: mol_type = other RNA
accttcctgctaagattca

SEQ ID NO: 177 - RNA, 19 nt, synthetic construct
  source 1..19: mol_type = other RNA
aagcagcagctgaacaaca

SEQ ID NO: 178 - RNA, 19 nt, synthetic construct
  source 1..19: mol_type = other RNA
agcagcagctgaacaacat

SEQ ID NO: 179 - RNA, 19 nt, synthetic construct
  source 1..19: mol_type = other RNA
cagcagctgaacaacatgt

SEQ ID NO: 180 - RNA, 19 nt, synthetic construct
  source 1..19: mol_type = other RNA
agcagctgaacaacatgtc

SEQ ID NO: 181 - RNA, 19 nt, synthetic construct
  source 1..19: mol_type = other RNA
gctgaacaacatgtcattt

SEQ ID NO: 182 - RNA, 19 nt, synthetic construct
  source 1..19: mol_type = other RNA
ctgaacaacatgtcatttg

SEQ ID NO: 183 - RNA, 19 nt, synthetic construct
  source 1..19: mol_type = other RNA
tgaacaacatgtcatttgc

SEQ ID NO: 184 - RNA, 19 nt, synthetic construct
  source 1..19: mol_type = other RNA
gaacaacatgtcatttgct

SEQ ID NO: 185 - RNA, 19 nt, synthetic construct
  source 1..19: mol_type = other RNA
aacaacatgtcatttgctg

SEQ ID NO: 186 - RNA, 19 nt, synthetic construct
  source 1..19: mol_type = other RNA
acaacatgtcatttgctga

SEQ ID NO: 187 - RNA, 19 nt, synthetic construct
  source 1..19: mol_type = other RNA
acatgtcatttgctgaaat

SEQ ID NO: 188 - RNA, 19 nt, synthetic construct
  source 1..19: mol_type = other RNA
atgtcatttgctgaaatca

SEQ ID NO: 189 - RNA, 19 nt, synthetic construct
  source 1..19: mol_type = other RNA
tgtcatttgctgaaatcat

SEQ ID NO: 190 - RNA, 19 nt, synthetic construct
  source 1..19: mol_type = other RNA
tttgctgaaatcatcatgg

SEQ ID NO: 191 - RNA, 19 nt, synthetic construct
  source 1..19: mol_type = other RNA
catacctgaagaccaagtt

SEQ ID NO: 192 - RNA, 19 nt, synthetic construct
  source 1..19: mol_type = other RNA
acctgaagaccaagtttat

SEQ ID NO: 193 - RNA, 19 nt, synthetic construct
  source 1..19: mol_type = other RNA
ctgaagaccaagtttatct

SEQ ID NO: 194 - RNA, 19 nt, synthetic construct
  source 1..19: mol_type = other RNA
gaagaccaagtttatctgt

SEQ ID NO: 195 - RNA, 19 nt, synthetic construct
  source 1..19: mol_type = other RNA
accaagtttatctgtgtga

SEQ ID NO: 196 - RNA, 19 nt, synthetic construct
  source 1..19: mol_type = other RNA
caagtttatctgtgtgaca

SEQ ID NO: 197 - RNA, 19 nt, synthetic construct
  source 1..19: mol_type = other RNA
agattcattgatgcagttt

SEQ ID NO: 198 - RNA, 19 nt, synthetic construct
  source 1..19: mol_type = other RNA
gattcattgatgcagtttg

SEQ ID NO: 199 - RNA, 19 nt, synthetic construct
  source 1..19: mol_type = other RNA
ttcattgatgcagtttgga

SEQ ID NO: 200 - RNA, 19 nt, synthetic construct
  source 1..19: mol_type = other RNA
tcattgatgcagtttggaa

SEQ ID NO: 201 - RNA, 19 nt, synthetic construct
  source 1..19: mol_type = other RNA
ttgatgcagtttggaaata

SEQ ID NO: 202 - RNA, 19 nt, synthetic construct
  source 1..19: mol_type = other RNA
tgatgcagtttggaaataa

SEQ ID NO: 203 - RNA, 19 nt, synthetic construct
  source 1..19: mol_type = other RNA
gatgcagtttggaaataat

SEQ ID NO: 204 - RNA, 19 nt, synthetic construct
  source 1..19: mol_type = other RNA
gcagtttggaaataatggt

SEQ ID NO: 205 - RNA, 19 nt, synthetic construct
  source 1..19: mol_type = other RNA
agtttggaaataatggtga

SEQ ID NO: 206 - RNA, 19 nt, synthetic construct
  source 1..19: mol_type = other RNA
tggaaataatggtgaaggt

SEQ ID NO: 207 - RNA, 19 nt, synthetic construct
  source 1..19: mol_type = other RNA
ataatggtgaaggtgctga

SEQ ID NO: 208 - RNA, 19 nt, synthetic construct
  source 1..19: mol_type = other RNA
ctgaaactactaactttgt

SEQ ID NO: 209 - RNA, 19 nt, synthetic construct
  source 1..19: mol_type = other RNA
aaactactaactttgtggt

SEQ ID NO: 210 - RNA, 19 nt, synthetic construct
  source 1..19: mol_type = other RNA
aactactaactttgtggtt

SEQ ID NO: 211 - RNA, 19 nt, synthetic construct
  source 1..19: mol_type = other RNA
actactaactttgtggttc

SEQ ID NO: 212 - RNA, 19 nt, synthetic construct
  source 1..19: mol_type = other RNA
taactttgtggttccagat

SEQ ID NO: 213 - RNA, 19 nt, synthetic construct
  source 1..19: mol_type = other RNA
ctttgtggttccagatttt

SEQ ID NO: 214 - RNA, 19 nt, synthetic construct
  source 1..19: mol_type = other RNA
tttgtggttccagattttt

SEQ ID NO: 215 - RNA, 19 nt, synthetic construct
  source 1..19: mol_type = other RNA
ttgtggttccagatttttt

SEQ ID NO: 216 - RNA, 19 nt, synthetic construct
  source 1..19: mol_type = other RNA
aaatagagaaatgagtgaa

SEQ ID NO: 217 - RNA, 19 nt, synthetic construct
  source 1..19: mol_type = other RNA
aatagagaaatgagtgaat

SEQ ID NO: 218 - RNA, 19 nt, synthetic construct
  source 1..19: mol_type = other RNA
ggtgatctgcttttatcta

SEQ ID NO: 219 - RNA, 19 nt, synthetic construct
  source 1..19: mol_type = other RNA
atctgcttttatctaaatg

SEQ ID NO: 220 - RNA, 19 nt, synthetic construct
  source 1..19: mol_type = other RNA
ctgcttttatctaaatgca

SEQ ID NO: 221 - RNA, 19 nt, synthetic construct
  source 1..19: mol_type = other RNA
atgcaaataaggatgtgtt

SEQ ID NO: 222 - RNA, 19 nt, synthetic construct
  source 1..19: mol_type = other RNA
ataaggatgtgttctctga

SEQ ID NO: 223 - RNA, 19 nt, synthetic construct
  source 1..19: mol_type = other RNA
gaaaaaggaaatgtcttgt

SEQ ID NO: 224 - RNA, 19 nt, synthetic construct
  source 1..19: mol_type = other RNA
aaaaggaaatgtcttgtgt

SEQ ID NO: 225 - RNA, 19 nt, synthetic construct
  source 1..19: mol_type = other RNA
aaaggaaatgtcttgtgtt

SEQ ID NO: 226 - RNA, 19 nt, synthetic construct
  source 1..19: mol_type = other RNA
aggaaatgtcttgtgttgt

SEQ ID NO: 227 - RNA, 19 nt, synthetic construct
  source 1..19: mol_type = other RNA
ggaaatgtcttgtgttgtt

SEQ ID NO: 228 - RNA, 19 nt, synthetic construct
  source 1..19: mol_type = other RNA
gaaatgtcttgtgttgttt

SEQ ID NO: 229 - RNA, 19 nt, synthetic construct
  source 1..19: mol_type = other RNA
aaatgtcttgtgttgtttt

SEQ ID NO: 230 - RNA, 19 nt, synthetic construct
  source 1..19: mol_type = other RNA
aatgtcttgtgttgttttg

SEQ ID NO: 231 - RNA, 19 nt, synthetic construct
  source 1..19: mol_type = other RNA
atgtcttgtgttgttttgt

SEQ ID NO: 232 - RNA, 19 nt, synthetic construct
  source 1..19: mol_type = other RNA
tgtcttgtgttgttttgtt

SEQ ID NO: 233 - RNA, 19 nt, synthetic construct
  source 1..19: mol_type = other RNA
gtcttgtgttgttttgttc

SEQ ID NO: 234 - RNA, 19 nt, synthetic construct
  source 1..19: mol_type = other RNA
ctcagcagctttttgttat

SEQ ID NO: 235 - RNA, 19 nt, synthetic construct
  source 1..19: mol_type = other RNA
cagcagctttttgttattg

SEQ ID NO: 236 - RNA, 19 nt, synthetic construct
  source 1..19: mol_type = other RNA
agcagctttttgttattgt

SEQ ID NO: 237 - RNA, 19 nt, synthetic construct
  source 1..19: mol_type = other RNA
gcagctttttgttattgtt

SEQ ID NO: 238 - RNA, 19 nt, synthetic construct
  source 1..19: mol_type = other RNA
cagctttttgttattgttg

SEQ ID NO: 239 - RNA, 19 nt, synthetic construct
  source 1..19: mol_type = other RNA
agctttttgttattgttgt

SEQ ID NO: 240 - RNA, 19 nt, synthetic construct
  source 1..19: mol_type = other RNA
gctttttgttattgttgtt

SEQ ID NO: 241 - RNA, 19 nt, synthetic construct
  source 1..19: mol_type = other RNA
ctttttgttattgttgttg

SEQ ID NO: 242 - RNA, 19 nt, synthetic construct
  source 1..19: mol_type = other RNA
tttttgttattgttgttgt

SEQ ID NO: 243 - RNA, 19 nt, synthetic construct
  source 1..19: mol_type = other RNA
ttttgttattgttgttgtt

SEQ ID NO: 244 - RNA, 19 nt, synthetic construct
  source 1..19: mol_type = other RNA
tttgttattgttgttgttg

SEQ ID NO: 245 - RNA, 19 nt, synthetic construct
  source 1..19: mol_type = other RNA
ttgttattgttgttgttgt

SEQ ID NO: 246 - RNA, 19 nt, synthetic construct
  source 1..19: mol_type = other RNA
tgttattgttgttgttgtt

SEQ ID NO: 247 - RNA, 19 nt, synthetic construct
  source 1..19: mol_type = other RNA
gttattgttgttgttgttc

SEQ ID NO: 248 - RNA, 19 nt, synthetic construct
  source 1..19: mol_type = other RNA
ttattgttgttgttgttct

SEQ ID NO: 249 - RNA, 19 nt, synthetic construct
  source 1..19: mol_type = other RNA
tattgttgttgttgttctt

SEQ ID NO: 250 - RNA, 19 nt, synthetic construct
  source 1..19: mol_type = other RNA
attgttgttgttgttctta

SEQ ID NO: 251 - RNA, 19 nt, synthetic construct
  source 1..19: mol_type = other RNA
tgttgttgttgttcttaga

SEQ ID NO: 252 - RNA, 19 nt, synthetic construct
  source 1..19: mol_type = other RNA
ttgttgttgttcttagaca

SEQ ID NO: 253 - RNA, 19 nt, synthetic construct
  source 1..19: mol_type = other RNA
tgttgttgttcttagacaa

SEQ ID NO: 254 - RNA, 19 nt, synthetic construct
  source 1..19: mol_type = other RNA
ctttttaaccttgctgaca

SEQ ID NO: 255 - RNA, 19 nt, synthetic construct
  source 1..19: mol_type = other RNA
ttaaccttgctgacatcca

SEQ ID NO: 256 - RNA, 19 nt, synthetic construct
  source 1..19: mol_type = other RNA
ttgctgacatccaaataga

SEQ ID NO: 257 - RNA, 19 nt, synthetic construct
  source 1..19: mol_type = other RNA
aggtttctttttaaattaa

SEQ ID NO: 258 - RNA, 19 nt, synthetic construct
  source 1..19: mol_type = other RNA
aaattaagaaataataaca

SEQ ID NO: 259 - RNA, 19 nt, synthetic construct
  source 1..19: mol_type = other RNA
aattaagaaataataacaa

SEQ ID NO: 260 - RNA, 19 nt, synthetic construct
  source 1..19: mol_type = other RNA
attaagaaataataacaat

SEQ ID NO: 261 - RNA, 19 nt, synthetic construct
  source 1..19: mol_type = other RNA
taagaaataataacaatta

SEQ ID NO: 262 - RNA, 19 nt, synthetic construct
  source 1..19: mol_type = other RNA
aagaaataataacaattaa

SEQ ID NO: 263 - RNA, 19 nt, synthetic construct
  source 1..19: mol_type = other RNA
agaaataataacaattaaa

SEQ ID NO: 264 - RNA, 19 nt, synthetic construct
  source 1..19: mol_type = other RNA
actaaaagtacaaaaaatt

SEQ ID NO: 265 - RNA, 19 nt, synthetic construct
  source 1..19: mol_type = other RNA
ctaaaagtacaaaaaatta

SEQ ID NO: 266 - RNA, 19 nt, synthetic construct
  source 1..19: mol_type = other RNA
agacttattttcctttgta

SEQ ID NO: 267 - RNA, 19 nt, synthetic construct
  source 1..19: mol_type = other RNA
attttcctttgtaatgtat

SEQ ID NO: 268 - RNA, 19 nt, synthetic construct
  source 1..19: mol_type = other RNA
agttacaggttggacatga

SEQ ID NO: 269 - RNA, 19 nt, synthetic construct
  source 1..19: mol_type = other RNA
tgtggaattctgtttgtta

SEQ ID NO: 270 - RNA, 19 nt, synthetic construct
  source 1..19: mol_type = other RNA
ggaattctgtttgttaaat

SEQ ID NO: 271 - RNA, 19 nt, synthetic construct
  source 1..19: mol_type = other RNA
attctgtttgttaaatcaa

SEQ ID NO: 272 - RNA, 19 nt, synthetic construct
  source 1..19: mol_type = other RNA
tgtttgttaaatcaaatta

SEQ ID NO: 273 - RNA, 19 nt, synthetic construct
  source 1..19: mol_type = other RNA
acataataagcttaactga

SEQ ID NO: 274 - RNA, 19 nt, synthetic construct
  source 1..19: mol_type = other RNA
actgataaacagaatattt

SEQ ID NO: 275 - RNA, 19 nt, synthetic construct
  source 1..19: mol_type = other RNA
ctgataaacagaatattta

SEQ ID NO: 276 - RNA, 19 nt, synthetic construct
  source 1..19: mol_type = other RNA
tagtgtaaaaatttatatt

SEQ ID NO: 277 - RNA, 19 nt, synthetic construct
  source 1..19: mol_type = other RNA
gtgtaaaaatttatattat

SEQ ID NO: 278 - RNA, 19 nt, synthetic construct
  source 1..19: mol_type = other RNA
taaaaatttatattattgt

SEQ ID NO: 279 - RNA, 19 nt, synthetic construct
  source 1..19: mol_type = other RNA
aaaaatttatattattgtg

SEQ ID NO: 280 - RNA, 19 nt, synthetic construct
  source 1..19: mol_type = other RNA
tttaacttccagaaataaa

SEQ ID NO: 281 - RNA, 19 nt, synthetic construct
  source 1..19: mol_type = other RNA
attatgaaacaccaaagtg

SEQ ID NO: 282 - RNA, 19 nt, synthetic construct
  source 1..19: mol_type = other RNA
agattatgaaacaccaaag

SEQ ID NO: 283 - RNA, 19 nt, synthetic construct
  source 1..19: mol_type = other RNA
aacattcgactcttgcagg

SEQ ID NO: 284 - RNA, 19 nt, synthetic construct
  source 1..19: mol_type = other RNA
gaacattcgactcttgcag

SEQ ID NO: 285 - RNA, 19 nt, synthetic construct
  source 1..19: mol_type = other RNA
agaacattcgactcttgca

SEQ ID NO: 286 - RNA, 19 nt, synthetic construct
  source 1..19: mol_type = other RNA
tagagaacattcgactctt

SEQ ID NO: 287 - RNA, 19 nt, synthetic construct
  source 1..19: mol_type = other RNA
atagagaacattcgactct

SEQ ID NO: 288 - RNA, 19 nt, synthetic construct
  source 1..19: mol_type = other RNA
tgatagagaacattcgact

SEQ ID NO: 289 - RNA, 19 nt, synthetic construct
  source 1..19: mol_type = other RNA
ctgatagagaacattcgac

SEQ ID NO: 290 - RNA, 19 nt, synthetic construct
  source 1..19: mol_type = other RNA
aaactgcttgattcttcgt

SEQ ID NO: 291 - RNA, 19 nt, synthetic construct
  source 1..19: mol_type = other RNA
gaaactgcttgattcttcg

SEQ ID NO: 292 - RNA, 19 nt, synthetic construct
  source 1..19: mol_type = other RNA
agaaactgcttgattcttc

SEQ ID NO: 293 - RNA, 19 nt, synthetic construct
  source 1..19: mol_type = other RNA
tccattggcttctcaagat

SEQ ID NO: 294 - RNA, 19 nt, synthetic construct
  source 1..19: mol_type = other RNA
attttctgttctagatcct

SEQ ID NO: 295 - RNA, 19 nt, synthetic construct
  source 1..19: mol_type = other RNA
ttcattttctgttctagat

SEQ ID NO: 296 - RNA, 19 nt, synthetic construct
  source 1..19: mol_type = other RNA
gaaatcaaagtcatcctgg

SEQ ID NO: 297 - RNA, 19 nt, synthetic construct
  source 1..19: mol_type = other RNA
tgaaatcaaagtcatcctg

SEQ ID NO: 298 - RNA, 19 nt, synthetic construct
  source 1..19: mol_type = other RNA
ttgaaatcaaagtcatcct

SEQ ID NO: 299 - RNA, 19 nt, synthetic construct
  source 1..19: mol_type = other RNA
tagttgaaatcaaagtcat

SEQ ID NO: 300 - RNA, 19 nt, synthetic construct
  source 1..19: mol_type = other RNA
atagttgaaatcaaagtca

SEQ ID NO: 301 - RNA, 19 nt, synthetic construct
  source 1..19: mol_type = other RNA
tatagttgaaatcaaagtc

SEQ ID NO: 302 - RNA, 19 nt, synthetic construct
  source 1..19: mol_type = other RNA
ttatagttgaaatcaaagt

SEQ ID NO: 303 - RNA, 19 nt, synthetic construct
  source 1..19: mol_type = other RNA
tttatagttgaaatcaaag

SEQ ID NO: 304 - RNA, 19 nt, synthetic construct
  source 1..19: mol_type = other RNA
ttgtttccattcagatctt

SEQ ID NO: 305 - RNA, 19 nt, synthetic construct
  source 1..19: mol_type = other RNA
tggttgtttccattcagat

SEQ ID NO: 306 - RNA, 19 nt, synthetic construct
  source 1..19: mol_type = other RNA
actggttgtttccattcag

SEQ ID NO: 307 - RNA, 19 nt, synthetic construct
  source 1..19: mol_type = other RNA
tgacgttatccagttttct

SEQ ID NO: 308 - RNA, 19 nt, synthetic construct
  source 1..19: mol_type = other RNA
atgacgttatccagttttc

SEQ ID NO: 309 - RNA, 19 nt, synthetic construct
  source 1..19: mol_type = other RNA
taatgacgttatccagttt

SEQ ID NO: 310 - RNA, 19 nt, synthetic construct
  source 1..19: mol_type = other RNA
tgctaatgacgttatccag

SEQ ID NO: 311 - RNA, 19 nt, synthetic construct
  source 1..19: mol_type = other RNA
tctgctaatgacgttatcc

SEQ ID NO: 312 - RNA, 19 nt, synthetic construct
  source 1..19: mol_type = other RNA
ttctgctaatgacgttatc

SEQ ID NO: 313 - RNA, 19 nt, synthetic construct
  source 1..19: mol_type = other RNA
attctgctaatgacgttat

SEQ ID NO: 314 - RNA, 19 nt, synthetic construct
  source 1..19: mol_type = other RNA
tccagtttcttaatttgtt

SEQ ID NO: 315 - RNA, 19 nt, synthetic construct
  source 1..19: mol_type = other RNA
aaactttttgctgcaactc

SEQ ID NO: 316 - RNA, 19 nt, synthetic construct
  source 1..19: mol_type = other RNA
gaaactttttgctgcaact

SEQ ID NO: 317 - RNA, 19 nt, synthetic construct
  source 1..19: mol_type = other RNA
tcattaagtttctaaacag

SEQ ID NO: 318 - RNA, 19 nt, synthetic construct
  source 1..19: mol_type = other RNA
cacttttcattaagtttct

SEQ ID NO: 319 - RNA, 19 nt, synthetic construct
  source 1..19: mol_type = other RNA
tgactttagtagtgaactg

SEQ ID NO: 320 - RNA, 19 nt, synthetic construct
  source 1..19: mol_type = other RNA
tcaactcagggaatttgac

SEQ ID NO: 321 - RNA, 19 nt, synthetic construct
  source 1..19: mol_type = other RNA
taattcaactcagggaatt

SEQ ID NO: 322 - RNA, 19 nt, synthetic construct
  source 1..19: mol_type = other RNA
ataattcaactcagggaat

SEQ ID NO: 323 - RNA, 19 nt, synthetic construct
  source 1..19: mol_type = other RNA
tgataattcaactcaggga

SEQ ID NO: 324 - RNA, 19 nt, synthetic construct
  source 1..19: mol_type = other RNA
gctgataattcaactcagg

SEQ ID NO: 325 - RNA, 19 nt, synthetic construct
  source 1..19: mol_type = other RNA
agctgataattcaactcag

SEQ ID NO: 326 - RNA, 19 nt, synthetic construct
  source 1..19: mol_type = other RNA
aagctgataattcaactca

SEQ ID NO: 327 - RNA, 19 nt, synthetic construct
  source 1..19: mol_type = other RNA
taagctgataattcaactc

SEQ ID NO: 328 - RNA, 19 nt, synthetic construct
  source 1..19: mol_type = other RNA
ttaagctgataattcaact

SEQ ID NO: 329 - RNA, 19 nt, synthetic construct
  source 1..19: mol_type = other RNA
tttaagctgataattcaac

SEQ ID NO: 330 - RNA, 19 nt, synthetic construct
  source 1..19: mol_type = other RNA
ttttaagctgataattcaa

SEQ ID NO: 331 - RNA, 19 nt, synthetic construct
  source 1..19: mol_type = other RNA
attttaagctgataattca

SEQ ID NO: 332 - RNA, 19 nt, synthetic construct
  source 1..19: mol_type = other RNA
taattttaagctgataatt

SEQ ID NO: 333 - RNA, 19 nt, synthetic construct
  source 1..19: mol_type = other RNA
ttaattttaagctgataat

SEQ ID NO: 334 - RNA, 19 nt, synthetic construct
  source 1..19: mol_type = other RNA
acactttaattttaagctg

SEQ ID NO: 335 - RNA, 19 nt, synthetic construct
  source 1..19: mol_type = other RNA
cacactttaattttaagct

SEQ ID NO: 336 - RNA, 19 nt, synthetic construct
  source 1..19: mol_type = other RNA
tcaatgcacactttaattt

SEQ ID NO: 337 - RNA, 19 nt, synthetic construct
  source 1..19: mol_type = other RNA
tctttgtcaatgcacactt

SEQ ID NO: 338 - RNA, 19 nt, synthetic construct
  source 1..19: mol_type = other RNA
tccatgttcatcacttttg

SEQ ID NO: 339 - RNA, 19 nt, synthetic construct
  source 1..19: mol_type = other RNA
attcttccatgttcatcac

SEQ ID NO: 340 - RNA, 19 nt, synthetic construct
  source 1..19: mol_type = other RNA
tcaagtgtttgaattctgc

SEQ ID NO: 341 - RNA, 19 nt, synthetic construct
  source 1..19: mol_type = other RNA
atcagggaagcatcacaat

SEQ ID NO: 342 - RNA, 19 nt, synthetic construct
  source 1..19: mol_type = other RNA
atcaccacaactggcaagg

SEQ ID NO: 343 - RNA, 19 nt, synthetic construct
  source 1..19: mol_type = other RNA
agatcaccacaactggcaa

SEQ ID NO: 344 - RNA, 19 nt, synthetic construct
  source 1..19: mol_type = other RNA
aaaagtttacattcttggg

SEQ ID NO: 345 - RNA, 19 nt, synthetic construct
  source 1..19: mol_type = other RNA
aaaaagtttacattcttgg

SEQ ID NO: 346 - RNA, 19 nt, synthetic construct
  source 1..19: mol_type = other RNA
aaaaaagtttacattcttg

SEQ ID NO: 347 - RNA, 19 nt, synthetic construct
  source 1..19: mol_type = other RNA
taaaaaagtttacattctt

SEQ ID NO: 348 - RNA, 19 nt, synthetic construct
  source 1..19: mol_type = other RNA
gtaaaaaagtttacattct

SEQ ID NO: 349 - RNA, 19 nt, synthetic construct
  source 1..19: mol_type = other RNA
tggtaaaaaagtttacatt

SEQ ID NO: 350 - RNA, 19 nt, synthetic construct
  source 1..19: mol_type = other RNA
tgaataattcacaccaggt

SEQ ID NO: 351 - RNA, 19 nt, synthetic construct
  source 1..19: mol_type = other RNA
cctgaataattcacaccag

SEQ ID NO: 352 - RNA, 19 nt, synthetic construct
  source 1..19: mol_type = other RNA
accctgaataattcacacc

SEQ ID NO: 353 - RNA, 19 nt, synthetic construct
  source 1..19: mol_type = other RNA
acaccctgaataattcaca

SEQ ID NO: 354 - RNA, 19 nt, synthetic construct
  source 1..19: mol_type = other RNA
ggtcaatgatattgtccag

SEQ ID NO: 355 - RNA, 19 nt, synthetic construct
  source 1..19: mol_type = other RNA
aaggtcaatgatattgtcc

SEQ ID NO: 356 - RNA, 19 nt, synthetic construct
  source 1..19: mol_type = other RNA
caaggtcaatgatattgtc

SEQ ID NO: 357 - RNA, 19 nt, synthetic construct
  source 1..19: mol_type = other RNA
acaaggtcaatgatattgt

SEQ ID NO: 358 - RNA, 19 nt, synthetic construct
  source 1..19: mol_type = other RNA
cacaaggtcaatgatattg

SEQ ID NO: 359 - RNA, 19 nt, synthetic construct
  source 1..19: mol_type = other RNA
tcacaaggtcaatgatatt

SEQ ID NO: 360 - RNA, 19 nt, synthetic construct
  source 1..19: mol_type = other RNA
ttcacaaggtcaatgatat

SEQ ID NO: 361 - RNA, 19 nt, synthetic construct
  source 1..19: mol_type = other RNA
tttcacaaggtcaatgata

SEQ ID NO: 362 - RNA, 19 nt, synthetic construct
  source 1..19: mol_type = other RNA
ttttcacaaggtcaatgat

SEQ ID NO: 363 - RNA, 19 nt, synthetic construct
  source 1..19: mol_type = other RNA
tttttcacaaggtcaatga

SEQ ID NO: 364 - RNA, 19 nt, synthetic construct
  source 1..19: mol_type = other RNA
actttttcacaaggtcaat

SEQ ID NO: 365 - RNA, 19 nt, synthetic construct
  source 1..19: mol_type = other RNA
tactttttcacaaggtcaa

SEQ ID NO: 366 - RNA, 19 nt, synthetic construct
  source 1..19: mol_type = other RNA
tgtactttttcacaaggtc

SEQ ID NO: 367 - RNA, 19 nt, synthetic construct
  source 1..19: mol_type = other RNA
atgtactttttcacaaggt

SEQ ID NO: 368 - RNA, 19 nt, synthetic construct
  source 1..19: mol_type = other RNA
tgaatcttagcaggaaggt

SEQ ID NO: 369 - RNA, 19 nt, synthetic construct
  source 1..19: mol_type = other RNA
tgttgttcagctgctgctt

SEQ ID NO: 370 - RNA, 19 nt, synthetic construct
  source 1..19: mol_type = other RNA
atgttgttcagctgctgct

SEQ ID NO: 371 - RNA, 19 nt, synthetic construct
  source 1..19: mol_type = other RNA
acatgttgttcagctgctg

SEQ ID NO: 372 - RNA, 19 nt, synthetic construct
  source 1..19: mol_type = other RNA
gacatgttgttcagctgct

SEQ ID NO: 373 - RNA, 19 nt, synthetic construct
  source 1..19: mol_type = other RNA
aaatgacatgttgttcagc

SEQ ID NO: 374 - RNA, 19 nt, synthetic construct
  source 1..19: mol_type = other RNA
caaatgacatgttgttcag

SEQ ID NO: 375 - RNA, 19 nt, synthetic construct
  source 1..19: mol_type = other RNA
gcaaatgacatgttgttca

SEQ ID NO: 376 - RNA, 19 nt, synthetic construct
  source 1..19: mol_type = other RNA
agcaaatgacatgttgttc

SEQ ID NO: 377 - RNA, 19 nt, synthetic construct
  source 1..19: mol_type = other RNA
cagcaaatgacatgttgtt

SEQ ID NO: 378 - RNA, 19 nt, synthetic construct
  source 1..19: mol_type = other RNA
tcagcaaatgacatgttgt

SEQ ID NO: 379 - RNA, 19 nt, synthetic construct
  source 1..19: mol_type = other RNA
atttcagcaaatgacatgt

SEQ ID NO: 380 - RNA, 19 nt, synthetic construct
  source 1..19: mol_type = other RNA
tgatttcagcaaatgacat

SEQ ID NO: 381 - RNA, 19 nt, synthetic construct
  source 1..19: mol_type = other RNA
atgatttcagcaaatgaca

SEQ ID NO: 382 - RNA, 19 nt, synthetic construct
  source 1..19: mol_type = other RNA
ccatgatgatttcagcaaa

SEQ ID NO: 383 - RNA, 19 nt, synthetic construct
  source 1..19: mol_type = other RNA
aacttggtcttcaggtatg

SEQ ID NO: 384 - RNA, 19 nt, synthetic construct
  source 1..19: mol_type = other RNA
ataaacttggtcttcaggt

SEQ ID NO: 385 - RNA, 19 nt, synthetic construct
  source 1..19: mol_type = other RNA
agataaacttggtcttcag

SEQ ID NO: 386 - RNA, 19 nt, synthetic construct
  source 1..19: mol_type = other RNA
acagataaacttggtcttc

SEQ ID NO: 387 - RNA, 19 nt, synthetic construct
  source 1..19: mol_type = other RNA
tcacacagataaacttggt

SEQ ID NO: 388 - RNA, 19 nt, synthetic construct
  source 1..19: mol_type = other RNA
tgtcacacagataaacttg

SEQ ID NO: 389 - RNA, 19 nt, synthetic construct
  source 1..19: mol_type = other RNA
aaactgcatcaatgaatct

SEQ ID NO: 390 - RNA, 19 nt, synthetic construct
  source 1..19: mol_type = other RNA
caaactgcatcaatgaatc

SEQ ID NO: 391 - RNA, 19 nt, synthetic construct
  source 1..19: mol_type = other RNA
tccaaactgcatcaatgaa

SEQ ID NO: 392 - RNA, 19 nt, synthetic construct
  source 1..19: mol_type = other RNA
ttccaaactgcatcaatga

SEQ ID NO: 393 - RNA, 19 nt, synthetic construct
  source 1..19: mol_type = other RNA
tatttccaaactgcatcaa

SEQ ID NO: 394 - RNA, 19 nt, synthetic construct
  source 1..19: mol_type = other RNA
ttatttccaaactgcatca

SEQ ID NO: 395 - RNA, 19 nt, synthetic construct
  source 1..19: mol_type = other RNA
attatttccaaactgcatc

SEQ ID NO: 396 - RNA, 19 nt, synthetic construct
  source 1..19: mol_type = other RNA
accattatttccaaactgc

SEQ ID NO: 397 - RNA, 19 nt, synthetic construct
  source 1..19: mol_type = other RNA
tcaccattatttccaaact

SEQ ID NO: 398 - RNA, 19 nt, synthetic construct
  source 1..19: mol_type = other RNA
accttcaccattatttcca

SEQ ID NO: 399 - RNA, 19 nt, synthetic construct
  source 1..19: mol_type = other RNA
tcagcaccttcaccattat

SEQ ID NO: 400 - RNA, 19 nt, synthetic construct
  source 1..19: mol_type = other RNA
acaaagttagtagtttcag

SEQ ID NO: 401 - RNA, 19 nt, synthetic construct
  source 1..19: mol_type = other RNA
accacaaagttagtagttt

SEQ ID NO: 402 - RNA, 19 nt, synthetic construct
  source 1..19: mol_type = other RNA
aaccacaaagttagtagtt

SEQ ID NO: 403 - RNA, 19 nt, synthetic construct
  source 1..19: mol_type = other RNA
gaaccacaaagttagtagt

SEQ ID NO: 404 - RNA, 19 nt, synthetic construct
  source 1..19: mol_type = other RNA
atctggaaccacaaagtta

SEQ ID NO: 405 - RNA, 19 nt, synthetic construct
  source 1..19: mol_type = other RNA
aaaatctggaaccacaaag

SEQ ID NO: 406 - RNA, 19 nt, synthetic construct
  source 1..19: mol_type = other RNA
aaaaatctggaaccacaaa

SEQ ID NO: 407 - RNA, 19 nt, synthetic construct
  source 1..19: mol_type = other RNA
aaaaaatctggaaccacaa

SEQ ID NO: 408 - RNA, 19 nt, synthetic construct
  source 1..19: mol_type = other RNA
ttcactcatttctctattt

SEQ ID NO: 409 - RNA, 19 nt, synthetic construct
  source 1..19: mol_type = other RNA
attcactcatttctctatt

SEQ ID NO: 410 - RNA, 19 nt, synthetic construct
  source 1..19: mol_type = other RNA
tagataaaagcagatcacc

SEQ ID NO: 411 - RNA, 19 nt, synthetic construct
  source 1..19: mol_type = other RNA
catttagataaaagcagat

SEQ ID NO: 412 - RNA, 19 nt, synthetic construct
  source 1..19: mol_type = other RNA
tgcatttagataaaagcag

SEQ ID NO: 413 - RNA, 19 nt, synthetic construct
  source 1..19: mol_type = other RNA
aacacatccttatttgcat

SEQ ID NO: 414 - RNA, 19 nt, synthetic construct
  source 1..19: mol_type = other RNA
tcagagaacacatccttat

SEQ ID NO: 415 - RNA, 19 nt, synthetic construct
  source 1..19: mol_type = other RNA
acaagacatttcctttttc

SEQ ID NO: 416 - RNA, 19 nt, synthetic construct
  source 1..19: mol_type = other RNA
acacaagacatttcctttt

SEQ ID NO: 417 - RNA, 19 nt, synthetic construct
  source 1..19: mol_type = other RNA
aacacaagacatttccttt

SEQ ID NO: 418 - RNA, 19 nt, synthetic construct
  source 1..19: mol_type = other RNA
acaacacaagacatttcct

SEQ ID NO: 419 - RNA, 19 nt, synthetic construct
  source 1..19: mol_type = other RNA
aacaacacaagacatttcc

SEQ ID NO: 420 - RNA, 19 nt, synthetic construct
  source 1..19: mol_type = other RNA
aaacaacacaagacatttc

SEQ ID NO: 421 - RNA, 19 nt, synthetic construct
  source 1..19: mol_type = other RNA
aaaacaacacaagacattt

SEQ ID NO: 422 - RNA, 19 nt, synthetic construct
  source 1..19: mol_type = other RNA
caaaacaacacaagacatt

SEQ ID NO: 423 - RNA, 19 nt, synthetic construct
  source 1..19: mol_type = other RNA
acaaaacaacacaagacat

SEQ ID NO: 424 - RNA, 19 nt, synthetic construct
  source 1..19: mol_type = other RNA
aacaaaacaacacaagaca

SEQ ID NO: 425 - RNA, 19 nt, synthetic construct
  source 1..19: mol_type = other RNA
gaacaaaacaacacaagac

SEQ ID NO: 426 - RNA, 19 nt, synthetic construct
  source 1..19: mol_type = other RNA
ataacaaaaagctgctgag

SEQ ID NO: 427 - RNA, 19 nt, synthetic construct
  source 1..19: mol_type = other RNA
caataacaaaaagctgctg

SEQ ID NO: 428 - RNA, 19 nt, synthetic construct
  source 1..19: mol_type = other RNA
acaataacaaaaagctgct

SEQ ID NO: 429 - RNA, 19 nt, synthetic construct
  source 1..19: mol_type = other RNA
aacaataacaaaaagctgc

SEQ ID NO: 430 - RNA, 19 nt, synthetic construct
  source 1..19: mol_type = other RNA
caacaataacaaaaagctg

SEQ ID NO: 431 - RNA, 19 nt, synthetic construct
  source 1..19: mol_type = other RNA
acaacaataacaaaaagct

SEQ ID NO: 432 - RNA, 19 nt, synthetic construct
  source 1..19: mol_type = other RNA
aacaacaataacaaaaagc

SEQ ID NO: 433 - RNA, 19 nt, synthetic construct
  source 1..19: mol_type = other RNA
caacaacaataacaaaaag

SEQ ID NO: 434 - RNA, 19 nt, synthetic construct
  source 1..19: mol_type = other RNA
acaacaacaataacaaaaa

SEQ ID NO: 435 - RNA, 19 nt, synthetic construct
  source 1..19: mol_type = other RNA
aacaacaacaataacaaaa

SEQ ID NO: 436 - RNA, 19 nt, synthetic construct
  source 1..19: mol_type = other RNA
caacaacaacaataacaaa

SEQ ID NO: 437 - RNA, 19 nt, synthetic construct
  source 1..19: mol_type = other RNA
acaacaacaacaataacaa

SEQ ID NO: 438 - RNA, 19 nt, synthetic construct
  source 1..19: mol_type = other RNA
aacaacaacaacaataaca

SEQ ID NO: 439 - RNA, 19 nt, synthetic construct
  source 1..19: mol_type = other RNA
gaacaacaacaacaataac

SEQ ID NO: 440 - RNA, 19 nt, synthetic construct
  source 1..19: mol_type = other RNA
agaacaacaacaacaataa

SEQ ID NO: 441 - RNA, 19 nt, synthetic construct
  source 1..19: mol_type = other RNA
aagaacaacaacaacaata

SEQ ID NO: 442 - RNA, 19 nt, synthetic construct
  source 1..19: mol_type = other RNA
taagaacaacaacaacaat

SEQ ID NO: 443 - RNA, 19 nt, synthetic construct
  source 1..19: mol_type = other RNA
tctaagaacaacaacaaca

SEQ ID NO: 444 - RNA, 19 nt, synthetic construct
  source 1..19: mol_type = other RNA
tgtctaagaacaacaacaa

SEQ ID NO: 445 - RNA, 19 nt, synthetic construct
  source 1..19: mol_type = other RNA
ttgtctaagaacaacaaca

SEQ ID NO: 446 - RNA, 19 nt, synthetic construct
  source 1..19: mol_type = other RNA
tgtcagcaaggttaaaaag

SEQ ID NO: 447 - RNA, 19 nt, synthetic construct
  source 1..19: mol_type = other RNA
tggatgtcagcaaggttaa

SEQ ID NO: 448 - RNA, 19 nt, synthetic construct
  source 1..19: mol_type = other RNA
tctatttggatgtcagcaa

SEQ ID NO: 449 - RNA, 19 nt, synthetic construct
  source 1..19: mol_type = other RNA
ttaatttaaaaagaaacct

SEQ ID NO: 450 - RNA, 19 nt, synthetic construct
  source 1..19: mol_type = other RNA
tgttattatttcttaattt

SEQ ID NO: 451 - RNA, 19 nt, synthetic construct
  source 1..19: mol_type = other RNA
ttgttattatttcttaatt

SEQ ID NO: 452 - RNA, 19 nt, synthetic construct
  source 1..19: mol_type = other RNA
attgttattatttcttaat

SEQ ID NO: 453 - RNA, 19 nt, synthetic construct
  source 1..19: mol_type = other RNA
taattgttattatttctta

SEQ ID NO: 454 - RNA, 19 nt, synthetic construct
  source 1..19: mol_type = other RNA
ttaattgttattatttctt

SEQ ID NO: 455 - RNA, 19 nt, synthetic construct
  source 1..19: mol_type = other RNA
tttaattgttattatttct

SEQ ID NO: 456 - RNA, 19 nt, synthetic construct
  source 1..19: mol_type = other RNA
aattttttgtacttttagt

SEQ ID NO: 457 - RNA, 19 nt, synthetic construct
  source 1..19: mol_type = other RNA
taattttttgtacttttag

SEQ ID NO: 458 - RNA, 19 nt, synthetic construct
  source 1..19: mol_type = other RNA
tacaaaggaaaataagtct

SEQ ID NO: 459 - RNA, 19 nt, synthetic construct
  source 1..19: mol_type = other RNA
atacattacaaaggaaaat

SEQ ID NO: 460 - RNA, 19 nt, synthetic construct
  source 1..19: mol_type = other RNA
tcatgtccaacctgtaact

SEQ ID NO: 461 - RNA, 19 nt, synthetic construct
  source 1..19: mol_type = other RNA
taacaaacagaattccaca

SEQ ID NO: 462 - RNA, 19 nt, synthetic construct
  source 1..19: mol_type = other RNA
atttaacaaacagaattcc

SEQ ID NO: 463 - RNA, 19 nt, synthetic construct
  source 1..19: mol_type = other RNA
ttgatttaacaaacagaat

SEQ ID NO: 464 - RNA, 19 nt, synthetic construct
  source 1..19: mol_type = other RNA
taatttgatttaacaaaca

SEQ ID NO: 465 - RNA, 19 nt, synthetic construct
  source 1..19: mol_type = other RNA
tcagttaagcttattatgt

SEQ ID NO: 466 - RNA, 19 nt, synthetic construct
  source 1..19: mol_type = other RNA
aaatattctgtttatcagt

SEQ ID NO: 467 - RNA, 19 nt, synthetic construct
  source 1..19: mol_type = other RNA
taaatattctgtttatcag

SEQ ID NO: 468 - RNA, 19 nt, synthetic construct
  source 1..19: mol_type = other RNA
aatataaatttttacacta

SEQ ID NO: 469 - RNA, 19 nt, synthetic construct
  source 1..19: mol_type = other RNA
ataatataaatttttacac

SEQ ID NO: 470 - RNA, 19 nt, synthetic construct
  source 1..19: mol_type = other RNA
acaataatataaattttta

SEQ ID NO: 471 - RNA, 19 nt, synthetic construct
  source 1..19: mol_type = other RNA
cacaataatataaattttt

SEQ ID NO: 472 - RNA, 19 nt, synthetic construct
  source 1..19: mol_type = other RNA
tttatttctggaagttaaa

SEQ ID NO: 473 - RNA, 25 nt, synthetic construct
  source 1..25: mol_type = other RNA
cactttggtgtttcataatagcagc

SEQ ID NO: 474 - RNA, 25 nt, synthetic construct
  source 1..25: mol_type = other RNA
ctttggtgtttcataatctagcagc

SEQ ID NO: 475 - RNA, 25 nt, synthetic construct
  source 1..25: mol_type = other RNA
cctgcaagagtcgaatgttagcagc

SEQ ID NO: 476 - RNA, 25 nt, synthetic construct
  source 1..25: mol_type = other RNA
ctgcaagagtcgaatgttcagcagc

SEQ ID NO: 477 - RNA, 25 nt, synthetic construct
  source 1..25: mol_type = other RNA
tgcaagagtcgaatgttctagcagc

SEQ ID NO: 478 - RNA, 25 nt, synthetic construct
  source 1..25: mol_type = other RNA
aagagtcgaatgttctctaagcagc

SEQ ID NO: 479 - RNA, 25 nt, synthetic construct
  source 1..25: mol_type = other RNA
agagtcgaatgttctctatagcagc

SEQ ID NO: 480 - RNA, 25 nt, synthetic construct
  source 1..25: mol_type = other RNA
agtcgaatgttctctatcaagcagc

SEQ ID NO: 481 - RNA, 25 nt, synthetic construct
  source 1..25: mol_type = other RNA
gtcgaatgttctctatcagagcagc

SEQ ID NO: 482 - RNA, 25 nt, synthetic construct
  source 1..25: mol_type = other RNA
acgaagaatcaagcagtttagcagc

SEQ ID NO: 483 - RNA, 25 nt, synthetic construct
  source 1..25: mol_type = other RNA
cgaagaatcaagcagtttcagcagc

SEQ ID NO: 484 - RNA, 25 nt, synthetic construct
  source 1..25: mol_type = other RNA
gaagaatcaagcagtttctagcagc

SEQ ID NO: 485 - RNA, 25 nt, synthetic construct
  source 1..25: mol_type = other RNA
atcttgagaagccaatggaagcagc

SEQ ID NO: 486 - RNA, 25 nt, synthetic construct
  source 1..25: mol_type = other RNA
aggatctagaacagaaaatagcagc

SEQ ID NO: 487 - RNA, 25 nt, synthetic construct
  source 1..25: mol_type = other RNA
atctagaacagaaaatgaaagcagc

SEQ ID NO: 488 - RNA, 25 nt, synthetic construct
  source 1..25: mol_type = other RNA
ccaggatgactttgatttcagcagc

SEQ ID NO: 489 - RNA, 25 nt, synthetic construct
  source 1..25: mol_type = other RNA
caggatgactttgatttcaagcagc

SEQ ID NO: 490 - RNA, 25 nt, synthetic construct
  source 1..25: mol_type = other RNA
aggatgactttgatttcaaagcagc

SEQ ID NO: 491 - RNA, 25 nt, synthetic construct
  source 1..25: mol_type = other RNA
atgactttgatttcaactaagcagc

SEQ ID NO: 492 - RNA, 25 nt, synthetic construct
  source 1..25: mol_type = other RNA
tgactttgatttcaactatagcagc

SEQ ID NO: 493 - RNA, 25 nt, synthetic construct
  source 1..25: mol_type = other RNA
gactttgatttcaactataagcagc

SEQ ID NO: 494 - RNA, 25 nt, synthetic construct
  source 1..25: mol_type = other RNA
actttgatttcaactataaagcagc

SEQ ID NO: 495 - RNA, 25 nt, synthetic construct
  source 1..25: mol_type = other RNA
ctttgatttcaactataaaagcagc

SEQ ID NO: 496 - RNA, 25 nt, synthetic construct
  source 1..25: mol_type = other RNA
aagatctgaatggaaacaaagcagc

SEQ ID NO: 497 - RNA, 25 nt, synthetic construct
  source 1..25: mol_type = other RNA
atctgaatggaaacaaccaagcagc

SEQ ID NO: 498 - RNA, 25 nt, synthetic construct
  source 1..25: mol_type = other RNA
ctgaatggaaacaaccagtagcagc

SEQ ID NO: 499 - RNA, 25 nt, synthetic construct
  source 1..25: mol_type = other RNA
agaaaactggataacgtcaagcagc

SEQ ID NO: 500 - RNA, 25 nt, synthetic construct
  source 1..25: mol_type = other RNA
gaaaactggataacgtcatagcagc

SEQ ID NO: 501 - RNA, 25 nt, synthetic construct
  source 1..25: mol_type = other RNA
aaactggataacgtcattaagcagc

SEQ ID NO: 502 - RNA, 25 nt, synthetic construct
  source 1..25: mol_type = other RNA
ctggataacgtcattagcaagcagc

SEQ ID NO: 503 - RNA, 25 nt, synthetic construct
  source 1..25: mol_type = other RNA
ggataacgtcattagcagaagcagc

SEQ ID NO: 504 - RNA, 25 nt, synthetic construct
  source 1..25: mol_type = other RNA
gataacgtcattagcagaaagcagc

SEQ ID NO: 505 - RNA, 25 nt, synthetic construct
  source 1..25: mol_type = other RNA
ataacgtcattagcagaatagcagc

SEQ ID NO: 506 - RNA, 25 nt, synthetic construct
  source 1..25: mol_type = other RNA
aacaaattaagaaactggaagcagc

SEQ ID NO: 507 - RNA, 25 nt, synthetic construct
  source 1..25: mol_type = other RNA
gagttgcagcaaaaagtttagcagc

SEQ ID NO: 508 - RNA, 25 nt, synthetic construct
  source 1..25: mol_type = other RNA
agttgcagcaaaaagtttcagcagc

SEQ ID NO: 509 - RNA, 25 nt, synthetic construct
  source 1..25: mol_type = other RNA
ctgtttagaaacttaatgaagcagc

SEQ ID NO: 510 - RNA, 25 nt, synthetic construct
  source 1..25: mol_type = other RNA
agaaacttaatgaaaagtgagcagc

SEQ ID NO: 511 - RNA, 25 nt, synthetic construct
  source 1..25: mol_type = other RNA
cagttcactactaaagtcaagcagc

SEQ ID NO: 512 - RNA, 25 nt, synthetic construct
  source 1..25: mol_type = other RNA
gtcaaattccctgagttgaagcagc

SEQ ID NO: 513 - RNA, 25 nt, synthetic construct
  source 1..25: mol_type = other RNA
aattccctgagttgaattaagcagc

SEQ ID NO: 514 - RNA, 25 nt, synthetic construct
  source 1..25: mol_type = other RNA
attccctgagttgaattatagcagc

SEQ ID NO: 515 - RNA, 25 nt, synthetic construct
  source 1..25: mol_type = other RNA
tccctgagttgaattatcaagcagc

SEQ ID NO: 516 - RNA, 25 nt, synthetic construct
  source 1..25: mol_type = other RNA
cctgagttgaattatcagcagcagc

SEQ ID NO: 517 - RNA, 25 nt, synthetic construct
  source 1..25: mol_type = other RNA
ctgagttgaattatcagctagcagc

SEQ ID NO: 518 - RNA, 25 nt, synthetic construct
  source 1..25: mol_type = other RNA
tgagttgaattatcagcttagcagc

SEQ ID NO: 519 - RNA, 25 nt, synthetic construct
  source 1..25: mol_type = other RNA
gagttgaattatcagcttaagcagc

SEQ ID NO: 520 - RNA, 25 nt, synthetic construct
  source 1..25: mol_type = other RNA
agttgaattatcagcttaaagcagc

SEQ ID NO: 521 - RNA, 25 nt, synthetic construct
  source 1..25: mol_type = other RNA
gttgaattatcagcttaaaagcagc

SEQ ID NO: 522 - RNA, 25 nt, synthetic construct
  source 1..25: mol_type = other RNA
ttgaattatcagcttaaaaagcagc

SEQ ID NO: 523 - RNA, 25 nt, synthetic construct
  source 1..25: mol_type = other RNA
tgaattatcagcttaaaatagcagc

SEQ ID NO: 524 - RNA, 25 nt, synthetic construct
  source 1..25: mol_type = other RNA
aattatcagcttaaaattaagcagc

SEQ ID NO: 525 - RNA, 25 nt, synthetic construct
  source 1..25: mol_type = other RNA
attatcagcttaaaattaaagcagc

SEQ ID NO: 526 - RNA, 25 nt, synthetic construct
  source 1..25: mol_type = other RNA
cagcttaaaattaaagtgtagcagc

SEQ ID NO: 527 - RNA, 25 nt, synthetic construct
  source 1..25: mol_type = other RNA
agcttaaaattaaagtgtgagcagc

SEQ ID NO: 528 - RNA, 25 nt, synthetic construct
  source 1..25: mol_type = other RNA
aaattaaagtgtgcattgaagcagc

SEQ ID NO: 529 - RNA, 25 nt, synthetic construct
  source 1..25: mol_type = other RNA
aagtgtgcattgacaaagaagcagc

SEQ ID NO: 530 - RNA, 25 nt, synthetic construct
  source 1..25: mol_type = other RNA
caaaagtgatgaacatggaagcagc

SEQ ID NO: 531 - RNA, 25 nt, synthetic construct
  source 1..25: mol_type = other RNA
gtgatgaacatggaagaatagcagc

SEQ ID NO: 532 - RNA, 25 nt, synthetic construct
  source 1..25: mol_type = other RNA
gcagaattcaaacacttgaagcagc

SEQ ID NO: 533 - RNA, 25 nt, synthetic construct
  source 1..25: mol_type = other RNA
attgtgatgcttccctgatagcagc

SEQ ID NO: 534 - RNA, 25 nt, synthetic construct
  source 1..25: mol_type = other RNA
ccttgccagttgtggtgatagcagc

SEQ ID NO: 535 - RNA, 25 nt, synthetic construct
  source 1..25: mol_type = other RNA
ttgccagttgtggtgatctagcagc

SEQ ID NO: 536 - RNA, 25 nt, synthetic construct
  source 1..25: mol_type = other RNA
cccaagaatgtaaacttttagcagc

SEQ ID NO: 537 - RNA, 25 nt, synthetic construct
  source 1..25: mol_type = other RNA
ccaagaatgtaaactttttagcagc

SEQ ID NO: 538 - RNA, 25 nt, synthetic construct
  source 1..25: mol_type = other RNA
caagaatgtaaacttttttagcagc

SEQ ID NO: 539 - RNA, 25 nt, synthetic construct
  source 1..25: mol_type = other RNA
aagaatgtaaacttttttaagcagc

SEQ ID NO: 540 - RNA, 25 nt, synthetic construct
  source 1..25: mol_type = other RNA
agaatgtaaacttttttacagcagc

SEQ ID NO: 541 - RNA, 25 nt, synthetic construct
  source 1..25: mol_type = other RNA
aatgtaaacttttttaccaagcagc

SEQ ID NO: 542 - RNA, 25 nt, synthetic construct
  source 1..25: mol_type = other RNA
acctggtgtgaattattcaagcagc

SEQ ID NO: 543 - RNA, 25 nt, synthetic construct
  source 1..25: mol_type = other RNA
ctggtgtgaattattcaggagcagc

SEQ ID NO: 544 - RNA, 25 nt, synthetic construct
  source 1..25: mol_type = other RNA
ggtgtgaattattcagggtagcagc

SEQ ID NO: 545 - RNA, 25 nt, synthetic construct
  source 1..25: mol_type = other RNA
tgtgaattattcagggtgtagcagc

SEQ ID NO: 546 - RNA, 25 nt, synthetic construct
  source 1..25: mol_type = other RNA
ctggacaatatcattgaccagcagc

SEQ ID NO: 547 - RNA, 25 nt, synthetic construct
  source 1..25: mol_type = other RNA
ggacaatatcattgaccttagcagc

SEQ ID NO: 548 - RNA, 25 nt, synthetic construct
  source 1..25: mol_type = other RNA
gacaatatcattgaccttgagcagc

SEQ ID NO: 549 - RNA, 25 nt, synthetic construct
  source 1..25: mol_type = other RNA
acaatatcattgaccttgtagcagc

SEQ ID NO: 550 - RNA, 25 nt, synthetic construct
  source 1..25: mol_type = other RNA
caatatcattgaccttgtgagcagc

SEQ ID NO: 551 - RNA, 25 nt, synthetic construct
  source 1..25: mol_type = other RNA
aatatcattgaccttgtgaagcagc

SEQ ID NO: 552 - RNA, 25 nt, synthetic construct
  source 1..25: mol_type = other RNA
atatcattgaccttgtgaaagcagc

SEQ ID NO: 553 - RNA, 25 nt, synthetic construct
  source 1..25: mol_type = other RNA
tatcattgaccttgtgaaaagcagc

SEQ ID NO: 554 - RNA, 25 nt, synthetic construct
  source 1..25: mol_type = other RNA
atcattgaccttgtgaaaaagcagc

SEQ ID NO: 555 - RNA, 25 nt, synthetic construct
  source 1..25: mol_type = other RNA
tcattgaccttgtgaaaaaagcagc

SEQ ID NO: 556 - RNA, 25 nt, synthetic construct
  source 1..25: mol_type = other RNA
attgaccttgtgaaaaagtagcagc

SEQ ID NO: 557 - RNA, 25 nt, synthetic construct
  source 1..25: mol_type = other RNA
ttgaccttgtgaaaaagtaagcagc

SEQ ID NO: 558 - RNA, 25 nt, synthetic construct
  source 1..25: mol_type = other RNA
gaccttgtgaaaaagtacaagcagc

SEQ ID NO: 559 - RNA, 25 nt, synthetic construct
  source 1..25: mol_type = other RNA
accttgtgaaaaagtacatagcagc

SEQ ID NO: 560 - RNA, 25 nt, synthetic construct
  source 1..25: mol_type = other RNA
accttcctgctaagattcaagcagc

SEQ ID NO: 561 - RNA, 25 nt, synthetic construct
  source 1..25: mol_type = other RNA
aagcagcagctgaacaacaagcagc

SEQ ID NO: 562 - RNA, 25 nt, synthetic construct
  source 1..25: mol_type = other RNA
agcagcagctgaacaacatagcagc

SEQ ID NO: 563 - RNA, 25 nt, synthetic construct
  source 1..25: mol_type = other RNA
cagcagctgaacaacatgtagcagc

SEQ ID NO: 564 - RNA, 25 nt, synthetic construct
  source 1..25: mol_type = other RNA
agcagctgaacaacatgtcagcagc

SEQ ID NO: 565 - RNA, 25 nt, synthetic construct
  source 1..25: mol_type = other RNA
gctgaacaacatgtcatttagcagc

SEQ ID NO: 566 - RNA, 25 nt, synthetic construct
  source 1..25: mol_type = other RNA
ctgaacaacatgtcatttgagcagc

SEQ ID NO: 567 - RNA, 25 nt, synthetic construct
  source 1..25: mol_type = other RNA
tgaacaacatgtcatttgcagcagc

SEQ ID NO: 568 - RNA, 25 nt, synthetic construct
  source 1..25: mol_type = other RNA
gaacaacatgtcatttgctagcagc

SEQ ID NO: 569 - RNA, 25 nt, synthetic construct
  source 1..25: mol_type = other RNA
aacaacatgtcatttgctgagcagc

SEQ ID NO: 570 - RNA, 25 nt, synthetic construct
  source 1..25: mol_type = other RNA
acaacatgtcatttgctgaagcagc

SEQ ID NO: 571 - RNA, 25 nt, synthetic construct
  source 1..25: mol_type = other RNA
acatgtcatttgctgaaatagcagc

SEQ ID NO: 572 - RNA, 25 nt, synthetic construct
  source 1..25: mol_type = other RNA
atgtcatttgctgaaatcaagcagc

SEQ ID NO: 573 - RNA, 25 nt, synthetic construct
  source 1..25: mol_type = other RNA
tgtcatttgctgaaatcatagcagc

SEQ ID NO: 574 - RNA, 25 nt, synthetic construct
  source 1..25: mol_type = other RNA
tttgctgaaatcatcatggagcagc

SEQ ID NO: 575 - RNA, 25 nt, synthetic construct
  source 1..25: mol_type = other RNA
catacctgaagaccaagttagcagc

SEQ ID NO: 576 - RNA, 25 nt, synthetic construct
  source 1..25: mol_type = other RNA
acctgaagaccaagtttatagcagc

SEQ ID NO: 577 - RNA, 25 nt, synthetic construct
  source 1..25: mol_type = other RNA
ctgaagaccaagtttatctagcagc

SEQ ID NO: 578 - RNA, 25 nt, synthetic construct
  source 1..25: mol_type = other RNA
gaagaccaagtttatctgtagcagc

SEQ ID NO: 579 - RNA, 25 nt, synthetic construct
  source 1..25: mol_type = other RNA
accaagtttatctgtgtgaagcagc

SEQ ID NO: 580 - RNA, 25 nt, synthetic construct
  source 1..25: mol_type = other RNA
caagtttatctgtgtgacaagcagc

SEQ ID NO: 581 - RNA, 25 nt, synthetic construct
  source 1..25: mol_type = other RNA
agattcattgatgcagtttagcagc

SEQ ID NO: 582 - RNA, 25 nt, synthetic construct
  source 1..25: mol_type = other RNA
gattcattgatgcagtttgagcagc

SEQ ID NO: 583 - RNA, 25 nt, synthetic construct
  source 1..25: mol_type = other RNA
ttcattgatgcagtttggaagcagc

SEQ ID NO: 584 - RNA, 25 nt, synthetic construct
  source 1..25: mol_type = other RNA
tcattgatgcagtttggaaagcagc

SEQ ID NO: 585 - RNA, 25 nt, synthetic construct
  source 1..25: mol_type = other RNA
ttgatgcagtttggaaataagcagc

SEQ ID NO: 586 - RNA, 25 nt, synthetic construct
  source 1..25: mol_type = other RNA
tgatgcagtttggaaataaagcagc

SEQ ID NO: 587 - RNA, 25 nt, synthetic construct
  source 1..25: mol_type = other RNA
gatgcagtttggaaataatagcagc

SEQ ID NO: 588 - RNA, 25 nt, synthetic construct
  source 1..25: mol_type = other RNA
gcagtttggaaataatggtagcagc

SEQ ID NO: 589 - RNA, 25 nt, synthetic construct
  source 1..25: mol_type = other RNA
agtttggaaataatggtgaagcagc

SEQ ID NO: 590 - RNA, 25 nt, synthetic construct
  source 1..25: mol_type = other RNA
tggaaataatggtgaaggtagcagc

SEQ ID NO: 591 - RNA, 25 nt, synthetic construct
  source 1..25: mol_type = other RNA
ataatggtgaaggtgctgaagcagc

SEQ ID NO: 592 - RNA, 25 nt, synthetic construct
  source 1..25: mol_type = other RNA
ctgaaactactaactttgtagcagc

SEQ ID NO: 593 - RNA, 25 nt, synthetic construct
  source 1..25: mol_type = other RNA
aaactactaactttgtggtagcagc

SEQ ID NO: 594 - RNA, 25 nt, synthetic construct
  source 1..25: mol_type = other RNA
aactactaactttgtggttagcagc

SEQ ID NO: 595 - RNA, 25 nt, synthetic construct
  source 1..25: mol_type = other RNA
actactaactttgtggttcagcagc

SEQ ID NO: 596 - RNA, 25 nt, synthetic construct
  source 1..25: mol_type = other RNA
taactttgtggttccagatagcagc

SEQ ID NO: 597 - RNA, 25 nt, synthetic construct
  source 1..25: mol_type = other RNA
ctttgtggttccagattttagcagc

SEQ ID NO: 598 - RNA, 25 nt, synthetic construct
  source 1..25: mol_type = other RNA
tttgtggttccagatttttagcagc

SEQ ID NO: 599 - RNA, 25 nt, synthetic construct
  source 1..25: mol_type = other RNA
ttgtggttccagattttttagcagc

SEQ ID NO: 600 - RNA, 25 nt, synthetic construct
  source 1..25: mol_type = other RNA
aaatagagaaatgagtgaaagcagc

SEQ ID NO: 601 - RNA, 25 nt, synthetic construct
  source 1..25: mol_type = other RNA
aatagagaaatgagtgaatagcagc

SEQ ID NO: 602 - RNA, 25 nt, synthetic construct
  source 1..25: mol_type = other RNA
ggtgatctgcttttatctaagcagc

SEQ ID NO: 603 - RNA, 25 nt, synthetic construct
  source 1..25: mol_type = other RNA
atctgcttttatctaaatgagcagc

SEQ ID NO: 604 - RNA, 25 nt, synthetic construct
  source 1..25: mol_type = other RNA
ctgcttttatctaaatgcaagcagc

SEQ ID NO: 605 - RNA, 25 nt, synthetic construct
  source 1..25: mol_type = other RNA
atgcaaataaggatgtgttagcagc

SEQ ID NO: 606 - RNA, 25 nt, synthetic construct
  source 1..25: mol_type = other RNA
ataaggatgtgttctctgaagcagc

SEQ ID NO: 607 - RNA, 25 nt, synthetic construct
  source 1..25: mol_type = other RNA
gaaaaaggaaatgtcttgtagcagc

SEQ ID NO: 608 - RNA, 25 nt, synthetic construct
  source 1..25: mol_type = other RNA
aaaaggaaatgtcttgtgtagcagc

SEQ ID NO: 609 - RNA, 25 nt, synthetic construct
  source 1..25: mol_type = other RNA
aaaggaaatgtcttgtgttagcagc

SEQ ID NO: 610 - RNA, 25 nt, synthetic construct
  source 1..25: mol_type = other RNA
aggaaatgtcttgtgttgtagcagc

SEQ ID NO: 611 - RNA, 25 nt, synthetic construct
  source 1..25: mol_type = other RNA
ggaaatgtcttgtgttgttagcagc

SEQ ID NO: 612 - RNA, 25 nt, synthetic construct
  source 1..25: mol_type = other RNA
gaaatgtcttgtgttgtttagcagc

SEQ ID NO: 613 - RNA, 25 nt, synthetic construct
  source 1..25: mol_type = other RNA
aaatgtcttgtgttgttttagcagc

SEQ ID NO: 614 - RNA, 25 nt, synthetic construct
  source 1..25: mol_type = other RNA
aatgtcttgtgttgttttgagcagc

SEQ ID NO: 615 - RNA, 25 nt, synthetic construct
  source 1..25: mol_type = other RNA
atgtcttgtgttgttttgtagcagc

SEQ ID NO: 616 - RNA, 25 nt, synthetic construct
  source 1..25: mol_type = other RNA
tgtcttgtgttgttttgttagcagc

SEQ ID NO: 617 - RNA, 25 nt, synthetic construct
  source 1..25: mol_type = other RNA
gtcttgtgttgttttgttcagcagc

SEQ ID NO: 618 - RNA, 25 nt, synthetic construct
  source 1..25: mol_type = other RNA
ctcagcagctttttgttatagcagc

SEQ ID NO: 619 - RNA, 25 nt, synthetic construct
  source 1..25: mol_type = other RNA
cagcagctttttgttattgagcagc

SEQ ID NO: 620 - RNA, 25 nt, synthetic construct
  source 1..25: mol_type = other RNA
agcagctttttgttattgtagcagc

SEQ ID NO: 621 - RNA, 25 nt, synthetic construct
  source 1..25: mol_type = other RNA
gcagctttttgttattgttagcagc

SEQ ID NO: 622 - RNA, 25 nt, synthetic construct
  source 1..25: mol_type = other RNA
cagctttttgttattgttgagcagc

SEQ ID NO: 623 - RNA, 25 nt, synthetic construct
  source 1..25: mol_type = other RNA
agctttttgttattgttgtagcagc

SEQ ID NO: 624 - RNA, 25 nt, synthetic construct
  source 1..25: mol_type = other RNA
gctttttgttattgttgttagcagc

SEQ ID NO: 625 - RNA, 25 nt, synthetic construct
  source 1..25: mol_type = other RNA
ctttttgttattgttgttgagcagc

SEQ ID NO: 626 - RNA, 25 nt, synthetic construct
  source 1..25: mol_type = other RNA
tttttgttattgttgttgtagcagc

SEQ ID NO: 627 - RNA, 25 nt, synthetic construct
  source 1..25: mol_type = other RNA
ttttgttattgttgttgttagcagc

SEQ ID NO: 628 - RNA, 25 nt, synthetic construct
  source 1..25: mol_type = other RNA
tttgttattgttgttgttgagcagc

SEQ ID NO: 629 - RNA, 25 nt, synthetic construct
  source 1..25: mol_type = other RNA
ttgttattgttgttgttgtagcagc

SEQ ID NO: 630 - RNA, 25 nt, synthetic construct
  source 1..25: mol_type = other RNA
tgttattgttgttgttgttagcagc

SEQ ID NO: 631 - RNA, 25 nt, synthetic construct
  source 1..25: mol_type = other RNA
gttattgttgttgttgttcagcagc

SEQ ID NO: 632 - RNA, 25 nt, synthetic construct
  source 1..25: mol_type = other RNA
ttattgttgttgttgttctagcagc

SEQ ID NO: 633 - RNA, 25 nt, synthetic construct
  source 1..25: mol_type = other RNA
tattgttgttgttgttcttagcagc

SEQ ID NO: 634 - RNA, 25 nt, synthetic construct
  source 1..25: mol_type = other RNA
attgttgttgttgttcttaagcagc

SEQ ID NO: 635 - RNA, 25 nt, synthetic construct
  source 1..25: mol_type = other RNA
tgttgttgttgttcttagaagcagc

SEQ ID NO: 636 - RNA, 25 nt, synthetic construct
  source 1..25: mol_type = other RNA
ttgttgttgttcttagacaagcagc

SEQ ID NO: 637 - RNA, 25 nt, synthetic construct
  source 1..25: mol_type = other RNA
tgttgttgttcttagacaaagcagc

SEQ ID NO: 638 - RNA, 25 nt, synthetic construct
  source 1..25: mol_type = other RNA
ctttttaaccttgctgacaagcagc

SEQ ID NO: 639 - RNA, 25 nt, synthetic construct
  source 1..25: mol_type = other RNA
ttaaccttgctgacatccaagcagc

SEQ ID NO: 640 - RNA, 25 nt, synthetic construct
  source 1..25: mol_type = other RNA
ttgctgacatccaaatagaagcagc

SEQ ID NO: 641 - RNA, 25 nt, synthetic construct
  source 1..25: mol_type = other RNA
aggtttctttttaaattaaagcagc

SEQ ID NO: 642 - RNA, 25 nt, synthetic construct
  source 1..25: mol_type = other RNA
aaattaagaaataataacaagcagc

SEQ ID NO: 643 - RNA, 25 nt, synthetic construct
  source 1..25: mol_type = other RNA
aattaagaaataataacaaagcagc

SEQ ID NO: 644 - RNA, 25 nt, synthetic construct
  source 1..25: mol_type = other RNA
attaagaaataataacaatagcagc

SEQ ID NO: 645 - RNA, 25 nt, synthetic construct
  source 1..25: mol_type = other RNA
taagaaataataacaattaagcagc

SEQ ID NO: 646 - RNA, 25 nt, synthetic construct
  source 1..25: mol_type = other RNA
aagaaataataacaattaaagcagc

SEQ ID NO: 647 - RNA, 25 nt, synthetic construct
  source 1..25: mol_type = other RNA
agaaataataacaattaaaagcagc

SEQ ID NO: 648 - RNA, 25 nt, synthetic construct
  source 1..25: mol_type = other RNA
actaaaagtacaaaaaattagcagc

SEQ ID NO: 649 - RNA, 25 nt, synthetic construct
  source 1..25: mol_type = other RNA
ctaaaagtacaaaaaattaagcagc

SEQ ID NO: 650 - RNA, 25 nt, synthetic construct
  source 1..25: mol_type = other RNA
agacttattttcctttgtaagcagc

SEQ ID NO: 651 - RNA, 25 nt, synthetic construct
  source 1..25: mol_type = other RNA
attttcctttgtaatgtatagcagc

SEQ ID NO: 652 - RNA, 25 nt, synthetic construct
  source 1..25: mol_type = other RNA
agttacaggttggacatgaagcagc

SEQ ID NO: 653 - RNA, 25 nt, synthetic construct
  source 1..25: mol_type = other RNA
tgtggaattctgtttgttaagcagc

SEQ ID NO: 654 - RNA, 25 nt, synthetic construct
  source 1..25: mol_type = other RNA
ggaattctgtttgttaaatagcagc

SEQ ID NO: 655 - RNA, 25 nt, synthetic construct
  source 1..25: mol_type = other RNA
attctgtttgttaaatcaaagcagc

SEQ ID NO: 656 - RNA, 25 nt, synthetic construct
  source 1..25: mol_type = other RNA
tgtttgttaaatcaaattaagcagc

SEQ ID NO: 657 - RNA, 25 nt, synthetic construct
  source 1..25: mol_type = other RNA
acataataagcttaactgaagcagc

SEQ ID NO: 658 - RNA, 25 nt, synthetic construct
  source 1..25: mol_type = other RNA
actgataaacagaatatttagcagc

SEQ ID NO: 659 - RNA, 25 nt, synthetic construct
  source 1..25: mol_type = other RNA
ctgataaacagaatatttaagcagc

SEQ ID NO: 660 - RNA, 25 nt, synthetic construct
  source 1..25: mol_type = other RNA
tagtgtaaaaatttatattagcagc

SEQ ID NO: 661 - RNA, 25 nt, synthetic construct
  source 1..25: mol_type = other RNA
gtgtaaaaatttatattatagcagc

SEQ ID NO: 662 - RNA, 25 nt, synthetic construct
  source 1..25: mol_type = other RNA
taaaaatttatattattgtagcagc

SEQ ID NO: 663 - RNA, 25 nt, synthetic construct
  source 1..25: mol_type = other RNA
aaaaatttatattattgtgagcagc

SEQ ID NO: 664 - RNA, 25 nt, synthetic construct
  source 1..25: mol_type = other RNA
tttaacttccagaaataaaagcagc

SEQ ID NO: 665 - RNA, 27 nt, synthetic construct
  source 1..27: mol_type = other RNA
gctgctattatgaaacaccaaagtggg

SEQ ID NO: 666 - RNA, 27 nt, synthetic construct
  source 1..27: mol_type = other RNA
gctgctagattatgaaacaccaaaggg

SEQ ID NO: 667 - RNA, 27 nt, synthetic construct
  source 1..27: mol_type = other RNA
gctgctaacattcgactcttgcagggg

SEQ ID NO: 668 - RNA, 27 nt, synthetic construct
  source 1..27: mol_type = other RNA
gctgctgaacattcgactcttgcaggg

SEQ ID NO: 669 - RNA, 27 nt, synthetic construct
  source 1..27: mol_type = other RNA
gctgctagaacattcgactcttgcagg

SEQ ID NO: 670 - RNA, 27 nt, synthetic construct
  source 1..27: mol_type = other RNA
gctgcttagagaacattcgactcttgg

SEQ ID NO: 671 - RNA, 27 nt, synthetic construct
  source 1..27: mol_type = other RNA
gctgctatagagaacattcgactctgg

SEQ ID NO: 672 - RNA, 27 nt, synthetic construct
  source 1..27: mol_type = other RNA
gctgcttgatagagaacattcgactgg

SEQ ID NO: 673 - RNA, 27 nt, synthetic construct
  source 1..27: mol_type = other RNA
gctgctctgatagagaacattcgacgg

SEQ ID NO: 674 - RNA, 27 nt, synthetic construct
  source 1..27: mol_type = other RNA
gctgctaaactgcttgattcttcgtgg

SEQ ID NO: 675 - RNA, 27 nt, synthetic construct
  source 1..27: mol_type = other RNA
gctgctgaaactgcttgattcttcggg

SEQ ID NO: 676 - RNA, 27 nt, synthetic construct
  source 1..27: mol_type = other RNA
gctgctagaaactgcttgattcttcgg

SEQ ID NO: 677 - RNA, 27 nt, synthetic construct
  source 1..27: mol_type = other RNA
gctgcttccattggcttctcaagatgg

SEQ ID NO: 678 - RNA, 27 nt, synthetic construct
  source 1..27: mol_type = other RNA
gctgctattttctgttctagatcctgg

SEQ ID NO: 679 - RNA, 27 nt, synthetic construct
  source 1..27: mol_type = other RNA
gctgctttcattttctgttctagatgg

SEQ ID NO: 680 - RNA, 27 nt, synthetic construct
  source 1..27: mol_type = other RNA
gctgctgaaatcaaagtcatcctgggg

SEQ ID NO: 681 - RNA, 27 nt, synthetic construct
  source 1..27: mol_type = other RNA
gctgcttgaaatcaaagtcatcctggg

SEQ ID NO: 682 - RNA, 27 nt, synthetic construct
  source 1..27: mol_type = other RNA
gctgctttgaaatcaaagtcatcctgg

SEQ ID NO: 683 - RNA, 27 nt, synthetic construct
  source 1..27: mol_type = other RNA
gctgcttagttgaaatcaaagtcatgg

SEQ ID NO: 684 - RNA, 27 nt, synthetic construct
  source 1..27: mol_type = other RNA
gctgctatagttgaaatcaaagtcagg

SEQ ID NO: 685 - RNA, 27 nt, synthetic construct
  source 1..27: mol_type = other RNA
gctgcttatagttgaaatcaaagtcgg

SEQ ID NO: 686 - RNA, 27 nt, synthetic construct
  source 1..27: mol_type = other RNA
gctgctttatagttgaaatcaaagtgg

SEQ ID NO: 687 - RNA, 27 nt, synthetic construct
  source 1..27: mol_type = other RNA
gctgcttttatagttgaaatcaaaggg

SEQ ID NO: 688 - RNA, 27 nt, synthetic construct
  source 1..27: mol_type = other RNA
gctgctttgtttccattcagatcttgg

SEQ ID NO: 689 - RNA, 27 nt, synthetic construct
  source 1..27: mol_type = other RNA
gctgcttggttgtttccattcagatgg

SEQ ID NO: 690 - RNA, 27 nt, synthetic construct
  source 1..27: mol_type = other RNA
gctgctactggttgtttccattcaggg

SEQ ID NO: 691 - RNA, 27 nt, synthetic construct
  source 1..27: mol_type = other RNA
gctgcttgacgttatccagttttctgg

SEQ ID NO: 692 - RNA, 27 nt, synthetic construct
  source 1..27: mol_type = other RNA
gctgctatgacgttatccagttttcgg

SEQ ID NO: 693 - RNA, 27 nt, synthetic construct
  source 1..27: mol_type = other RNA
gctgcttaatgacgttatccagtttgg

SEQ ID NO: 694 - RNA, 27 nt, synthetic construct
  source 1..27: mol_type = other RNA
gctgcttgctaatgacgttatccaggg

SEQ ID NO: 695 - RNA, 27 nt, synthetic construct
  source 1..27: mol_type = other RNA
gctgcttctgctaatgacgttatccgg

SEQ ID NO: 696 - RNA, 27 nt, synthetic construct
  source 1..27: mol_type = other RNA
gctgctttctgctaatgacgttatcgg

SEQ ID NO: 697 - RNA, 27 nt, synthetic construct
  source 1..27: mol_type = other RNA
gctgctattctgctaatgacgttatgg

SEQ ID NO: 698 - RNA, 27 nt, synthetic construct
  source 1..27: mol_type = other RNA
gctgcttccagtttcttaatttgttgg

SEQ ID NO: 699 - RNA, 27 nt, synthetic construct
  source 1..27: mol_type = other RNA
gctgctaaactttttgctgcaactcgg

SEQ ID NO: 700 - RNA, 27 nt, synthetic construct
  source 1..27: mol_type = other RNA
gctgctgaaactttttgctgcaactgg

SEQ ID NO: 701 - RNA, 27 nt, synthetic construct
  source 1..27: mol_type = other RNA
gctgcttcattaagtttctaaacaggg

SEQ ID NO: 702 - RNA, 27 nt, synthetic construct
  source 1..27: mol_type = other RNA
gctgctcacttttcattaagtttctgg

SEQ ID NO: 703 - RNA, 27 nt, synthetic construct
  source 1..27: mol_type = other RNA
gctgcttgactttagtagtgaactggg

SEQ ID NO: 704 - RNA, 27 nt, synthetic construct
  source 1..27: mol_type = other RNA
gctgcttcaactcagggaatttgacgg

SEQ ID NO: 705 - RNA, 27 nt, synthetic construct
  source 1..27: mol_type = other RNA
gctgcttaattcaactcagggaattgg

SEQ ID NO: 706 - RNA, 27 nt, synthetic construct
  source 1..27: mol_type = other RNA
gctgctataattcaactcagggaatgg

SEQ ID NO: 707 - RNA, 27 nt, synthetic construct
  source 1..27: mol_type = other RNA
gctgcttgataattcaactcagggagg

SEQ ID NO: 708 - RNA, 27 nt, synthetic construct
  source 1..27: mol_type = other RNA
gctgctgctgataattcaactcagggg

SEQ ID NO: 709 - RNA, 27 nt, synthetic construct
  source 1..27: mol_type = other RNA
gctgctagctgataattcaactcaggg

SEQ ID NO: 710 - RNA, 27 nt, synthetic construct
  source 1..27: mol_type = other RNA
gctgctaagctgataattcaactcagg

SEQ ID NO: 711 - RNA, 27 nt, synthetic construct
  source 1..27: mol_type = other RNA
gctgcttaagctgataattcaactcgg

SEQ ID NO: 712 - RNA, 27 nt, synthetic construct
  source 1..27: mol_type = other RNA
gctgctttaagctgataattcaactgg

SEQ ID NO: 713 - RNA, 27 nt, synthetic construct
  source 1..27: mol_type = other RNA
gctgcttttaagctgataattcaacgg

SEQ ID NO: 714 - RNA, 27 nt, synthetic construct
  source 1..27: mol_type = other RNA
gctgctttttaagctgataattcaagg

SEQ ID NO: 715 - RNA, 27 nt, synthetic construct
  source 1..27: mol_type = other RNA
gctgctattttaagctgataattcagg

SEQ ID NO: 716 - RNA, 27 nt, synthetic construct
  source 1..27: mol_type = other RNA
gctgcttaattttaagctgataattgg

SEQ ID NO: 717 - RNA, 27 nt, synthetic construct
  source 1..27: mol_type = other RNA
gctgctttaattttaagctgataatgg

SEQ ID NO: 718 - RNA, 27 nt, synthetic construct
  source 1..27: mol_type = other RNA
gctgctacactttaattttaagctggg

SEQ ID NO: 719 - RNA, 27 nt, synthetic construct
  source 1..27: mol_type = other RNA
gctgctcacactttaattttaagctgg

SEQ ID NO: 720 - RNA, 27 nt, synthetic construct
  source 1..27: mol_type = other RNA
gctgcttcaatgcacactttaatttgg

SEQ ID NO: 721 - RNA, 27 nt, synthetic construct
  source 1..27: mol_type = other RNA
gctgcttctttgtcaatgcacacttgg

SEQ ID NO: 722 - RNA, 27 nt, synthetic construct
  source 1..27: mol_type = other RNA
gctgcttccatgttcatcacttttggg

SEQ ID NO: 723 - RNA, 27 nt, synthetic construct
  source 1..27: mol_type = other RNA
gctgctattcttccatgttcatcacgg

SEQ ID NO: 724 - RNA, 27 nt, synthetic construct
  source 1..27: mol_type = other RNA
gctgcttcaagtgtttgaattctgcgg

SEQ ID NO: 725 - RNA, 27 nt, synthetic construct
  source 1..27: mol_type = other RNA
gctgctatcagggaagcatcacaatgg

SEQ ID NO: 726 - RNA, 27 nt, synthetic construct
  source 1..27: mol_type = other RNA
gctgctatcaccacaactggcaagggg

SEQ ID NO: 727 - RNA, 27 nt, synthetic construct
  source 1..27: mol_type = other RNA
gctgctagatcaccacaactggcaagg

SEQ ID NO: 728 - RNA, 27 nt, synthetic construct
  source 1..27: mol_type = other RNA
gctgctaaaagtttacattcttggggg

SEQ ID NO: 729 - RNA, 27 nt, synthetic construct
  source 1..27: mol_type = other RNA
gctgctaaaaagtttacattcttgggg

SEQ ID NO: 730 - RNA, 27 nt, synthetic construct
  source 1..27: mol_type = other RNA
gctgctaaaaaagtttacattcttggg

SEQ ID NO: 731 - RNA, 27 nt, synthetic construct
  source 1..27: mol_type = other RNA
gctgcttaaaaaagtttacattcttgg

SEQ ID NO: 732 - RNA, 27 nt, synthetic construct
  source 1..27: mol_type = other RNA
gctgctgtaaaaaagtttacattctgg

SEQ ID NO: 733 - RNA, 27 nt, synthetic construct
  source 1..27: mol_type = other RNA
gctgcttggtaaaaaagtttacattgg

SEQ ID NO: 734 - RNA, 27 nt, synthetic construct
  source 1..27: mol_type = other RNA
gctgcttgaataattcacaccaggtgg

SEQ ID NO: 735 - RNA, 27 nt, synthetic construct
  source 1..27: mol_type = other RNA
gctgctcctgaataattcacaccaggg

SEQ ID NO: 736 - RNA, 27 nt, synthetic construct
  source 1..27: mol_type = other RNA
gctgctaccctgaataattcacaccgg

SEQ ID NO: 737 - RNA, 27 nt, synthetic construct
  source 1..27: mol_type = other RNA
gctgctacaccctgaataattcacagg

SEQ ID NO: 738 - RNA, 27 nt, synthetic construct
  source 1..27: mol_type = other RNA
gctgctggtcaatgatattgtccaggg

SEQ ID NO: 739 - RNA, 27 nt, synthetic construct
  source 1..27: mol_type = other RNA
gctgctaaggtcaatgatattgtccgg

SEQ ID NO: 740 - RNA, 27 nt, synthetic construct
  source 1..27: mol_type = other RNA
gctgctcaaggtcaatgatattgtcgg

SEQ ID NO: 741 - RNA, 27 nt, synthetic construct
  source 1..27: mol_type = other RNA
gctgctacaaggtcaatgatattgtgg

SEQ ID NO: 742 - RNA, 27 nt, synthetic construct
  source 1..27: mol_type = other RNA
gctgctcacaaggtcaatgatattggg

SEQ ID NO: 743 - RNA, 27 nt, synthetic construct
  source 1..27: mol_type = other RNA
gctgcttcacaaggtcaatgatattgg

SEQ ID NO: 744 - RNA, 27 nt, synthetic construct
  source 1..27: mol_type = other RNA
gctgctttcacaaggtcaatgatatgg

SEQ ID NO: 745 - RNA, 27 nt, synthetic construct
  source 1..27: mol_type = other RNA
gctgcttttcacaaggtcaatgatagg

SEQ ID NO: 746 - RNA, 27 nt, synthetic construct
  source 1..27: mol_type = other RNA
gctgctttttcacaaggtcaatgatgg

SEQ ID NO: 747 - RNA, 27 nt, synthetic construct
  source 1..27: mol_type = other RNA
gctgcttttttcacaaggtcaatgagg

SEQ ID NO: 748 - RNA, 27 nt, synthetic construct
  source 1..27: mol_type = other RNA
gctgctactttttcacaaggtcaatgg

SEQ ID NO: 749 - RNA, 27 nt, synthetic construct
  source 1..27: mol_type = other RNA
gctgcttactttttcacaaggtcaagg

SEQ ID NO: 750 - RNA, 27 nt, synthetic construct
  source 1..27: mol_type = other RNA
gctgcttgtactttttcacaaggtcgg

SEQ ID NO: 751 - RNA, 27 nt, synthetic construct
  source 1..27: mol_type = other RNA
gctgctatgtactttttcacaaggtgg

SEQ ID NO: 752 - RNA, 27 nt, synthetic construct
  source 1..27: mol_type = other RNA
gctgcttgaatcttagcaggaaggtgg

SEQ ID NO: 753 - RNA, 27 nt, synthetic construct
  source 1..27: mol_type = other RNA
gctgcttgttgttcagctgctgcttgg

SEQ ID NO: 754 - RNA, 27 nt, synthetic construct
  source 1..27: mol_type = other RNA
gctgctatgttgttcagctgctgctgg

SEQ ID NO: 755 - RNA, 27 nt, synthetic construct
  source 1..27: mol_type = other RNA
gctgctacatgttgttcagctgctggg

SEQ ID NO: 756 - RNA, 27 nt, synthetic construct
  source 1..27: mol_type = other RNA
gctgctgacatgttgttcagctgctgg

SEQ ID NO: 757 - RNA, 27 nt, synthetic construct
  source 1..27: mol_type = other RNA
gctgctaaatgacatgttgttcagcgg

SEQ ID NO: 758 - RNA, 27 nt, synthetic construct
  source 1..27: mol_type = other RNA
gctgctcaaatgacatgttgttcaggg

SEQ ID NO: 759 - RNA, 27 nt, synthetic construct
  source 1..27: mol_type = other RNA
gctgctgcaaatgacatgttgttcagg

SEQ ID NO: 760 - RNA, 27 nt, synthetic construct
  source 1..27: mol_type = other RNA
gctgctagcaaatgacatgttgttcgg

SEQ ID NO: 761 - RNA, 27 nt, synthetic construct
  source 1..27: mol_type = other RNA
gctgctcagcaaatgacatgttgttgg

SEQ ID NO: 762 - RNA, 27 nt, synthetic construct
  source 1..27: mol_type = other RNA
gctgcttcagcaaatgacatgttgtgg

SEQ ID NO: 763 - RNA, 27 nt, synthetic construct
  source 1..27: mol_type = other RNA
gctgctatttcagcaaatgacatgtgg

SEQ ID NO: 764 - RNA, 27 nt, synthetic construct
  source 1..27: mol_type = other RNA
gctgcttgatttcagcaaatgacatgg

SEQ ID NO: 765 - RNA, 27 nt, synthetic construct
  source 1..27: mol_type = other RNA
gctgctatgatttcagcaaatgacagg

SEQ ID NO: 766 - RNA, 27 nt, synthetic construct
  source 1..27: mol_type = other RNA
gctgctccatgatgatttcagcaaagg

SEQ ID NO: 767 - RNA, 27 nt, synthetic construct
  source 1..27: mol_type = other RNA
gctgctaacttggtcttcaggtatggg

SEQ ID NO: 768 - RNA, 27 nt, synthetic construct
  source 1..27: mol_type = other RNA
gctgctataaacttggtcttcaggtgg

SEQ ID NO: 769 - RNA, 27 nt, synthetic construct
  source 1..27: mol_type = other RNA
gctgctagataaacttggtcttcaggg

SEQ ID NO: 770 - RNA, 27 nt, synthetic construct
  source 1..27: mol_type = other RNA
gctgctacagataaacttggtcttcgg

SEQ ID NO: 771 - RNA, 27 nt, synthetic construct
  source 1..27: mol_type = other RNA
gctgcttcacacagataaacttggtgg

SEQ ID NO: 772 - RNA, 27 nt, synthetic construct
  source 1..27: mol_type = other RNA
gctgcttgtcacacagataaacttggg

SEQ ID NO: 773 - RNA, 27 nt, synthetic construct
  source 1..27: mol_type = other RNA
gctgctaaactgcatcaatgaatctgg

SEQ ID NO: 774 - RNA, 27 nt, synthetic construct
  source 1..27: mol_type = other RNA
gctgctcaaactgcatcaatgaatcgg

SEQ ID NO: 775 - RNA, 27 nt, synthetic construct
  source 1..27: mol_type = other RNA
gctgcttccaaactgcatcaatgaagg

SEQ ID NO: 776 - RNA, 27 nt, synthetic construct
  source 1..27: mol_type = other RNA
gctgctttccaaactgcatcaatgagg

SEQ ID NO: 777 - RNA, 27 nt, synthetic construct
  source 1..27: mol_type = other RNA
gctgcttatttccaaactgcatcaagg

SEQ ID NO: 778 - RNA, 27 nt, synthetic construct
  source 1..27: mol_type = other RNA
gctgctttatttccaaactgcatcagg

SEQ ID NO: 779 - RNA, 27 nt, synthetic construct
  source 1..27: mol_type = other RNA
gctgctattatttccaaactgcatcgg

SEQ ID NO: 780 - RNA, 27 nt, synthetic construct
  source 1..27: mol_type = other RNA
gctgctaccattatttccaaactgcgg

SEQ ID NO: 781 - RNA, 27 nt, synthetic construct
  source 1..27: mol_type = other RNA
gctgcttcaccattatttccaaactgg

SEQ ID NO: 782 - RNA, 27 nt, synthetic construct
  source 1..27: mol_type = other RNA
gctgctaccttcaccattatttccagg

SEQ ID NO: 783 - RNA, 27 nt, synthetic construct
  source 1..27: mol_type = other RNA
gctgcttcagcaccttcaccattatgg

SEQ ID NO: 784 - RNA, 27 nt, synthetic construct
  source 1..27: mol_type = other RNA
gctgctacaaagttagtagtttcaggg

SEQ ID NO: 785 - RNA, 27 nt, synthetic construct
  source 1..27: mol_type = other RNA
gctgctaccacaaagttagtagtttgg

SEQ ID NO: 786 - RNA, 27 nt, synthetic construct
  source 1..27: mol_type = other RNA
gctgctaaccacaaagttagtagttgg

SEQ ID NO: 787 - RNA, 27 nt, synthetic construct
  source 1..27: mol_type = other RNA
gctgctgaaccacaaagttagtagtgg

SEQ ID NO: 788 - RNA, 27 nt, synthetic construct
  source 1..27: mol_type = other RNA
gctgctatctggaaccacaaagttagg

SEQ ID NO: 789 - RNA, 27 nt, synthetic construct
  source 1..27: mol_type = other RNA
gctgctaaaatctggaaccacaaaggg

SEQ ID NO: 790 - RNA, 27 nt, synthetic construct
  source 1..27: mol_type = other RNA
gctgctaaaaatctggaaccacaaagg

SEQ ID NO: 791 - RNA, 27 nt, synthetic construct
  source 1..27: mol_type = other RNA
gctgctaaaaaatctggaaccacaagg

SEQ ID NO: 792 - RNA, 27 nt, synthetic construct
  source 1..27: mol_type = other RNA
gctgctttcactcatttctctatttgg

SEQ ID NO: 793 - RNA, 27 nt, synthetic construct
  source 1..27: mol_type = other RNA
gctgctattcactcatttctctattgg

SEQ ID NO: 794 - RNA, 27 nt, synthetic construct
  source 1..27: mol_type = other RNA
gctgcttagataaaagcagatcaccgg

SEQ ID NO: 795 - RNA, 27 nt, synthetic construct
  source 1..27: mol_type = other RNA
gctgctcatttagataaaagcagatgg

SEQ ID NO: 796 - RNA, 27 nt, synthetic construct
  source 1..27: mol_type = other RNA
gctgcttgcatttagataaaagcaggg

SEQ ID NO: 797 - RNA, 27 nt, synthetic construct
  source 1..27: mol_type = other RNA
gctgctaacacatccttatttgcatgg

SEQ ID NO: 798 - RNA, 27 nt, synthetic construct
  source 1..27: mol_type = other RNA
gctgcttcagagaacacatccttatgg

SEQ ID NO: 799 - RNA, 27 nt, synthetic construct
  source 1..27: mol_type = other RNA
gctgctacaagacatttcctttttcgg

SEQ ID NO: 800 - RNA, 27 nt, synthetic construct
  source 1..27: mol_type = other RNA
gctgctacacaagacatttccttttgg

SEQ ID NO: 801 - RNA, 27 nt, synthetic construct
  source 1..27: mol_type = other RNA
gctgctaacacaagacatttcctttgg

SEQ ID NO: 802 - RNA, 27 nt, synthetic construct
  source 1..27: mol_type = other RNA
gctgctacaacacaagacatttcctgg

SEQ ID NO: 803 - RNA, 27 nt, synthetic construct
  source 1..27: mol_type = other RNA
gctgctaacaacacaagacatttccgg

SEQ ID NO: 804 - RNA, 27 nt, synthetic construct
  source 1..27: mol_type = other RNA
gctgctaaacaacacaagacatttcgg

SEQ ID NO: 805 - RNA, 27 nt, synthetic construct
  source 1..27: mol_type = other RNA
gctgctaaaacaacacaagacatttgg

SEQ ID NO: 806 - RNA, 27 nt, synthetic construct
  source 1..27: mol_type = other RNA
gctgctcaaaacaacacaagacattgg

SEQ ID NO: 807 - RNA, 27 nt, synthetic construct
  source 1..27: mol_type = other RNA
gctgctacaaaacaacacaagacatgg

SEQ ID NO: 808 - RNA, 27 nt, synthetic construct
  source 1..27: mol_type = other RNA
gctgctaacaaaacaacacaagacagg

SEQ ID NO: 809 - RNA, 27 nt, synthetic construct
  source 1..27: mol_type = other RNA
gctgctgaacaaaacaacacaagacgg

SEQ ID NO: 810 - RNA, 27 nt, synthetic construct
  source 1..27: mol_type = other RNA
gctgctataacaaaaagctgctgaggg

SEQ ID NO: 811 - RNA, 27 nt, synthetic construct
  source 1..27: mol_type = other RNA
gctgctcaataacaaaaagctgctggg

SEQ ID NO: 812 - RNA, 27 nt, synthetic construct
  source 1..27: mol_type = other RNA
gctgctacaataacaaaaagctgctgg

SEQ ID NO: 813 - RNA, 27 nt, synthetic construct
  source 1..27: mol_type = other RNA
gctgctaacaataacaaaaagctgcgg

SEQ ID NO: 814 - RNA, 27 nt, synthetic construct
  source 1..27: mol_type = other RNA
gctgctcaacaataacaaaaagctggg

SEQ ID NO: 815 - RNA, 27 nt, synthetic construct
  source 1..27: mol_type = other RNA
gctgctacaacaataacaaaaagctgg

SEQ ID NO: 816 - RNA, 27 nt, synthetic construct
  source 1..27: mol_type = other RNA
gctgctaacaacaataacaaaaagcgg

SEQ ID NO: 817 - RNA, 27 nt, synthetic construct
  source 1..27: mol_type = other RNA
gctgctcaacaacaataacaaaaaggg

SEQ ID NO: 818 - RNA, 27 nt, synthetic construct
  source 1..27: mol_type = other RNA
gctgctacaacaacaataacaaaaagg

SEQ ID NO: 819 - RNA, 27 nt, synthetic construct
  source 1..27: mol_type = other RNA
gctgctaacaacaacaataacaaaagg

SEQ ID NO: 820 - RNA, 27 nt, synthetic construct
  source 1..27: mol_type = other RNA
gctgctcaacaacaacaataacaaagg

SEQ ID NO: 821 - RNA, 27 nt, synthetic construct
  source 1..27: mol_type = other RNA
gctgctacaacaacaacaataacaagg

SEQ ID NO: 822 - RNA, 27 nt, synthetic construct
  source 1..27: mol_type = other RNA
gctgctaacaacaacaacaataacagg

SEQ ID NO: 823 - RNA, 27 nt, synthetic construct
  source 1..27: mol_type = other RNA
gctgctgaacaacaacaacaataacgg

SEQ ID NO: 824 - RNA, 27 nt, synthetic construct
  source 1..27: mol_type = other RNA
gctgctagaacaacaacaacaataagg

SEQ ID NO: 825 - RNA, 27 nt, synthetic construct
  source 1..27: mol_type = other RNA
gctgctaagaacaacaacaacaatagg

SEQ ID NO: 826 - RNA, 27 nt, synthetic construct
  source 1..27: mol_type = other RNA
gctgcttaagaacaacaacaacaatgg

SEQ ID NO: 827 - RNA, 27 nt, synthetic construct
  source 1..27: mol_type = other RNA
gctgcttctaagaacaacaacaacagg

SEQ ID NO: 828 - RNA, 27 nt, synthetic construct
  source 1..27: mol_type = other RNA
gctgcttgtctaagaacaacaacaagg

SEQ ID NO: 829 - RNA, 27 nt, synthetic construct
  source 1..27: mol_type = other RNA
gctgctttgtctaagaacaacaacagg

SEQ ID NO: 830 - RNA, 27 nt, synthetic construct
  source 1..27: mol_type = other RNA
gctgcttgtcagcaaggttaaaaaggg

SEQ ID NO: 831 - RNA, 27 nt, synthetic construct
  source 1..27: mol_type = other RNA
gctgcttggatgtcagcaaggttaagg

SEQ ID NO: 832 - RNA, 27 nt, synthetic construct
  source 1..27: mol_type = other RNA
gctgcttctatttggatgtcagcaagg

SEQ ID NO: 833 - RNA, 27 nt, synthetic construct
  source 1..27: mol_type = other RNA
gctgctttaatttaaaaagaaacctgg

SEQ ID NO: 834 - RNA, 27 nt, synthetic construct
  source 1..27: mol_type = other RNA
gctgcttgttattatttcttaatttgg

SEQ ID NO: 835 - RNA, 27 nt, synthetic construct
  source 1..27: mol_type = other RNA
gctgctttgttattatttcttaattgg

SEQ ID NO: 836 - RNA, 27 nt, synthetic construct
  source 1..27: mol_type = other RNA
gctgctattgttattatttcttaatgg

SEQ ID NO: 837 - RNA, 27 nt, synthetic construct
  source 1..27: mol_type = other RNA
gctgcttaattgttattatttcttagg

SEQ ID NO: 838 - RNA, 27 nt, synthetic construct
  source 1..27: mol_type = other RNA
gctgctttaattgttattatttcttgg

SEQ ID NO: 839 - RNA, 27 nt, synthetic construct
  source 1..27: mol_type = other RNA
gctgcttttaattgttattatttctgg

SEQ ID NO: 840 - RNA, 27 nt, synthetic construct
  source 1..27: mol_type = other RNA
gctgctaattttttgtacttttagtgg

SEQ ID NO: 841 - RNA, 27 nt, synthetic construct
  source 1..27: mol_type = other RNA
gctgcttaattttttgtacttttaggg

SEQ ID NO: 842 - RNA, 27 nt, synthetic construct
  source 1..27: mol_type = other RNA
gctgcttacaaaggaaaataagtctgg

SEQ ID NO: 843 - RNA, 27 nt, synthetic construct
  source 1..27: mol_type = other RNA
gctgctatacattacaaaggaaaatgg

SEQ ID NO: 844 - RNA, 27 nt, synthetic construct
  source 1..27: mol_type = other RNA
gctgcttcatgtccaacctgtaactgg

SEQ ID NO: 845 - RNA, 27 nt, synthetic construct
  source 1..27: mol_type = other RNA
gctgcttaacaaacagaattccacagg

SEQ ID NO: 846 - RNA, 27 nt, synthetic construct
  source 1..27: mol_type = other RNA
gctgctatttaacaaacagaattccgg

SEQ ID NO: 847 - RNA, 27 nt, synthetic construct
  source 1..27: mol_type = other RNA
gctgctttgatttaacaaacagaatgg

SEQ ID NO: 848 - RNA, 27 nt, synthetic construct
  source 1..27: mol_type = other RNA
gctgcttaatttgatttaacaaacagg

SEQ ID NO: 849 - RNA, 27 nt, synthetic construct
  source 1..27: mol_type = other RNA
gctgcttcagttaagcttattatgtgg

SEQ ID NO: 850 - RNA, 27 nt, synthetic construct
  source 1..27: mol_type = other RNA
gctgctaaatattctgtttatcagtgg

SEQ ID NO: 851 - RNA, 27 nt, synthetic construct
  source 1..27: mol_type = other RNA
gctgcttaaatattctgtttatcaggg

SEQ ID NO: 852 - RNA, 27 nt, synthetic construct
  source 1..27: mol_type = other RNA
gctgctaatataaatttttacactagg

SEQ ID NO: 853 - RNA, 27 nt, synthetic construct
  source 1..27: mol_type = other RNA
gctgctataatataaatttttacacgg

SEQ ID NO: 854 - RNA, 27 nt, synthetic construct
  source 1..27: mol_type = other RNA
gctgctacaataatataaatttttagg

SEQ ID NO: 855 - RNA, 27 nt, synthetic construct
  source 1..27: mol_type = other RNA
gctgctcacaataatataaatttttgg

SEQ ID NO: 856 - RNA, 27 nt, synthetic construct
  source 1..27: mol_type = other RNA
gctgcttttatttctggaagttaaagg

SEQ ID NO: 857 - RNA, 36 nt, synthetic construct
  source 1..36: mol_type = other RNA
ccaggatgactttgatttcagcagccgaaaggctgc

SEQ ID NO: 858 - RNA, 36 nt, synthetic construct
  source 1..36: mol_type = other RNA
caggatgactttgatttcaagcagccgaaaggctgc

SEQ ID NO: 859 - RNA, 36 nt, synthetic construct
  source 1..36: mol_type = other RNA
aggatgactttgatttcaaagcagccgaaaggctgc

SEQ ID NO: 860 - RNA, 36 nt, synthetic construct
  source 1..36: mol_type = other RNA
atgactttgatttcaactaagcagccgaaaggctgc

SEQ ID NO: 861 - RNA, 36 nt, synthetic construct
  source 1..36: mol_type = other RNA
ctttggtgtttcataatctagcagccgaaaggctgc

SEQ ID NO: 862 - RNA, 36 nt, synthetic construct
  source 1..36: mol_type = other RNA
tgactttgatttcaactatagcagccgaaaggctgc

SEQ ID NO: 863 - RNA, 36 nt, synthetic construct
  source 1..36: mol_type = other RNA
gactttgatttcaactataagcagccgaaaggctgc

SEQ ID NO: 864 - RNA, 36 nt, synthetic construct
  source 1..36: mol_type = other RNA
aagatctgaatggaaacaaagcagccgaaaggctgc

SEQ ID NO: 865 - RNA, 36 nt, synthetic construct
  source 1..36: mol_type = other RNA
gaaaactggataacgtcatagcagccgaaaggctgc

SEQ ID NO: 866 - RNA, 36 nt, synthetic construct
  source 1..36: mol_type = other RNA
ctggataacgtcattagcaagcagccgaaaggctgc

SEQ ID NO: 867 - RNA, 36 nt, synthetic construct
  source 1..36: mol_type = other RNA
ctgtttagaaacttaatgaagcagccgaaaggctgc

SEQ ID NO: 868 - RNA, 36 nt, synthetic construct
  source 1..36: mol_type = other RNA
agaaacttaatgaaaagtgagcagccgaaaggctgc

SEQ ID NO: 869 - RNA, 36 nt, synthetic construct
  source 1..36: mol_type = other RNA
gtcaaattccctgagttgaagcagccgaaaggctgc

SEQ ID NO: 870 - RNA, 36 nt, synthetic construct
  source 1..36: mol_type = other RNA
attccctgagttgaattatagcagccgaaaggctgc

SEQ ID NO: 871 - RNA, 36 nt, synthetic construct; identical to SEQ ID NO: 29
  source 1..36: mol_type = other RNA

SEQ ID NO: 872 - RNA, 36 nt, synthetic construct; identical to SEQ ID NO: 33
  source 1..36: mol_type = other RNA

SEQ ID NO: 873 - RNA, 36 nt, synthetic construct; identical to SEQ ID NO: 33
  source 1..36: mol_type = other RNA

SEQ ID NO: 874 - RNA, 36 nt, synthetic construct
  source 1..36: mol_type = other RNA
tgaattatcagcttaaaatagcagccgaaaggctgc

SEQ ID NO: 875 - RNA, 36 nt, synthetic construct
  source 1..36: mol_type = other RNA
aattatcagcttaaaattaagcagccgaaaggctgc

SEQ ID NO: 876 - RNA, 36 nt, synthetic construct
  source 1..36: mol_type = other RNA
attatcagcttaaaattaaagcagccgaaaggctgc

SEQ ID NO: 877 - RNA, 36 nt, synthetic construct
  source 1..36: mol_type = other RNA
cagcttaaaattaaagtgtagcagccgaaaggctgc

SEQ ID NO: 878 - RNA, 36 nt, synthetic construct
  source 1..36: mol_type = other RNA
agcttaaaattaaagtgtgagcagccgaaaggctgc

SEQ ID NO: 879 - RNA, 36 nt, synthetic construct
  source 1..36: mol_type = other RNA
tgtgaattattcagggtgtagcagccgaaaggctgc

SEQ ID NO: 880 - RNA, 36 nt, synthetic construct
  source 1..36: mol_type = other RNA
acaatatcattgaccttgtagcagccgaaaggctgc

SEQ ID NO: 881 - RNA, 36 nt, synthetic construct
  source 1..36: mol_type = other RNA
aatatcattgaccttgtgaagcagccgaaaggctgc

SEQ ID NO: 882 - RNA, 36 nt, synthetic construct
  source 1..36: mol_type = other RNA
atcattgaccttgtgaaaaagcagccgaaaggctgc

SEQ ID NO: 883 - RNA, 36 nt, synthetic construct
  source 1..36: mol_type = other RNA
tgtcatttgctgaaatcatagcagccgaaaggctgc

SEQ ID NO: 884 - RNA, 36 nt, synthetic construct
  source 1..36: mol_type = other RNA
ctgaagaccaagtttatctagcagccgaaaggctgc

SEQ ID NO: 885 - RNA, 36 nt, synthetic construct
  source 1..36: mol_type = other RNA
caagtttatctgtgtgacaagcagccgaaaggctgc

SEQ ID NO: 886 - RNA, 36 nt, synthetic construct
  source 1..36: mol_type = other RNA
agtttggaaataatggtgaagcagccgaaaggctgc

SEQ ID NO: 887 - RNA, 36 nt, synthetic construct
  source 1..36: mol_type = other RNA
aaatagagaaatgagtgaaagcagccgaaaggctgc

SEQ ID NO: 888 - RNA, 36 nt, synthetic construct
  source 1..36: mol_type = other RNA
aatagagaaatgagtgaatagcagccgaaaggctgc

SEQ ID NO: 889 - RNA, 36 nt, synthetic construct
  source 1..36: mol_type = other RNA
ttgtggttccagattttttagcagccgaaaggctgc

SEQ ID NO: 890 - RNA, 36 nt, synthetic construct
  source 1..36: mol_type = other RNA
tttgtggttccagatttttagcagccgaaaggctgc

SEQ ID NO: 891 - RNA, 36 nt, synthetic construct
  source 1..36: mol_type = other RNA
ttcattgatgcagtttggaagcagccgaaaggctgc

SEQ ID NO: 892 - RNA, 36 nt, synthetic construct
  source 1..36: mol_type = other RNA
tgatgcagtttggaaataaagcagccgaaaggctgc

SEQ ID NO: 893 - RNA, 36 nt, synthetic construct
  source 1..36: mol_type = other RNA
acatgtcatttgctgaaatagcagccgaaaggctgc

SEQ ID NO: 894 - RNA, 36 nt, synthetic construct
  source 1..36: mol_type = other RNA
ctttgtggttccagattttagcagccgaaaggctgc

SEQ ID NO: 895 - RNA, 36 nt, synthetic construct
  source 1..36: mol_type = other RNA
taaaaatttatattattgtagcagccgaaaggctgc

SEQ ID NO: 896 - RNA, 36 nt, synthetic construct
  source 1..36: mol_type = other RNA
tcattgatgcagtttggaaagcagccgaaaggctgc

SEQ ID NO: 897 - RNA, 36 nt, synthetic construct
  source 1..36: mol_type = other RNA
tttgctgaaatcatcatggagcagccgaaaggctgc

SEQ ID NO: 898 - RNA, 36 nt, synthetic construct
  source 1..36: mol_type = other RNA
gaacaacatgtcatttgctagcagccgaaaggctgc

SEQ ID NO: 899 - RNA, 36 nt, synthetic construct
  source 1..36: mol_type = other RNA
acaacatgtcatttgctgaagcagccgaaaggctgc

SEQ ID NO: 900 - RNA, 36 nt, synthetic construct
  source 1..36: mol_type = other RNA
aacaacatgtcatttgctgagcagccgaaaggctgc

SEQ ID NO: 901 - RNA, 36 nt, synthetic construct
  source 1..36: mol_type = other RNA
cgaagaatcaagcagtttcagcagccgaaaggctgc

SEQ ID NO: 902 - RNA, 36 nt, synthetic construct
  source 1..36: mol_type = other RNA
ccttgccagttgtggtgatagcagccgaaaggctgc

SEQ ID NO: 903 - RNA, 36 nt, synthetic construct
  source 1..36: mol_type = other RNA
aacaaattaagaaactggaagcagccgaaaggctgc

SEQ ID NO: 904 - RNA, 36 nt, synthetic construct
  source 1..36: mol_type = other RNA
ctgaatggaaacaaccagtagcagccgaaaggctgc

SEQ ID NO: 905 - RNA, 36 nt, synthetic construct
  source 1..36: mol_type = other RNA
atcttgagaagccaatggaagcagccgaaaggctgc

SEQ ID NO: 906 - RNA, 36 nt, synthetic construct
  source 1..36: mol_type = other RNA
gaagaatcaagcagtttctagcagccgaaaggctgc

SEQ ID NO: 907 - RNA, 36 nt, synthetic construct
  source 1..36: mol_type = other RNA
ttgccagttgtggtgatctagcagccgaaaggctgc

SEQ ID NO: 908 - RNA, 36 nt, synthetic construct
  source 1..36: mol_type = other RNA
atctgaatggaaacaaccaagcagccgaaaggctgc

SEQ ID NO: 909 - RNA, 36 nt, synthetic construct
  source 1..36: mol_type = other RNA
atctagaacagaaaatgaaagcagccgaaaggctgc

SEQ ID NO: 910 - RNA, 36 nt, synthetic construct
  source 1..36: mol_type = other RNA
aggatctagaacagaaaatagcagccgaaaggctgc

SEQ ID NO: 911 - RNA, 36 nt, synthetic construct
  source 1..36: mol_type = other RNA
aaaaatttatattattgtgagcagccgaaaggctgc

SEQ ID NO: 912 - RNA, 36 nt, synthetic construct
  source 1..36: mol_type = other RNA
gtgtaaaaatttatattatagcagccgaaaggctgc

SEQ ID NO: 913 - RNA, 36 nt, synthetic construct
  source 1..36: mol_type = other RNA
agttgcagcaaaaagtttcagcagccgaaaggctgc

SEQ ID NO: 914 - RNA, 36 nt, synthetic construct
  source 1..36: mol_type = other RNA
aagaatgtaaacttttttaagcagccgaaaggctgc

SEQ ID NO: 915 - RNA, 36 nt, synthetic construct
  source 1..36: mol_type = other RNA
tgcaagagtcgaatgttctagcagccgaaaggctgc

SEQ ID NO: 916 - RNA, 36 nt, synthetic construct
  source 1..36: mol_type = other RNA
agattcattgatgcagtttagcagccgaaaggctgc

SEQ ID NO: 917 - RNA, 36 nt, synthetic construct
  source 1..36: mol_type = other RNA
gagttgcagcaaaaagtttagcagccgaaaggctgc

SEQ ID NO: 918 - RNA, 36 nt, synthetic construct
  source 1..36: mol_type = other RNA
gtcgaatgttctctatcagagcagccgaaaggctgc

SEQ ID NO: 919 - RNA, 36 nt, synthetic construct
  source 1..36: mol_type = other RNA
cccaagaatgtaaacttttagcagccgaaaggctgc

SEQ ID NO: 920 - RNA, 36 nt, synthetic construct
  source 1..36: mol_type = other RNA
gtgatgaacatggaagaatagcagccgaaaggctgc

SEQ ID NO: 921 - RNA, 36 nt, synthetic construct
  source 1..36: mol_type = other RNA
aagagtcgaatgttctctaagcagccgaaaggctgc

SEQ ID NO: 922 - RNA, 36 nt, synthetic construct
  source 1..36: mol_type = other RNA
gattcattgatgcagtttgagcagccgaaaggctgc

SEQ ID NO: 923 - RNA, 36 nt, synthetic construct
  source 1..36: mol_type = other RNA
agagtcgaatgttctctatagcagccgaaaggctgc

SEQ ID NO: 924 - RNA, 36 nt, synthetic construct
  source 1..36: mol_type = other RNA
agtcgaatgttctctatcaagcagccgaaaggctgc

SEQ ID NO: 925 - RNA, 36 nt, synthetic construct
  source 1..36: mol_type = other RNA
ctggtgtgaattattcaggagcagccgaaaggctgc

SEQ ID NO: 926 - RNA, 36 nt, synthetic construct
  source 1..36: mol_type = other RNA
cctgcaagagtcgaatgttagcagccgaaaggctgc

SEQ ID NO: 927 - RNA, 36 nt, synthetic construct
  source 1..36: mol_type = other RNA
accttcctgctaagattcaagcagccgaaaggctgc

SEQ ID NO: 928 - RNA, 36 nt, synthetic construct
  source 1..36: mol_type = other RNA
acctggtgtgaattattcaagcagccgaaaggctgc

SEQ ID NO: 929 - RNA, 36 nt, synthetic construct
  source 1..36: mol_type = other RNA
agaatgtaaacttttttacagcagccgaaaggctgc

SEQ ID NO: 930 - RNA, 36 nt, synthetic construct
  source 1..36: mol_type = other RNA
cagttcactactaaagtcaagcagccgaaaggctgc

SEQ ID NO: 931 - RNA, 36 nt, synthetic construct
  source 1..36: mol_type = other RNA
caagaatgtaaacttttttagcagccgaaaggctgc

SEQ ID NO: 932 - RNA, 36 nt, synthetic construct
  source 1..36: mol_type = other RNA
ctgcaagagtcgaatgttcagcagccgaaaggctgc

SEQ ID NO: 933 - RNA, 36 nt, synthetic construct
  source 1..36: mol_type = other RNA
ggtgtgaattattcagggtagcagccgaaaggctgc

SEQ ID NO: 934 - RNA, 36 nt, synthetic construct
  source 1..36: mol_type = other RNA
ccaagaatgtaaactttttagcagccgaaaggctgc

SEQ ID NO: 935 - RNA, 36 nt, synthetic construct
  source 1..36: mol_type = other RNA
agcagcagctgaacaacatagcagccgaaaggctgc

SEQ ID NO: 936 - RNA, 36 nt, synthetic construct
  source 1..36: mol_type = other RNA
gctgaacaacatgtcatttagcagccgaaaggctgc

SEQ ID NO: 937 - RNA, 36 nt, synthetic construct
  source 1..36: mol_type = other RNA
ctgaacaacatgtcatttgagcagccgaaaggctgc

SEQ ID NO: 938 - RNA, 36 nt, synthetic construct
  source 1..36: mol_type = other RNA
cagcagctgaacaacatgtagcagccgaaaggctgc

SEQ ID NO: 939 - RNA, 36 nt, synthetic construct
  source 1..36: mol_type = other RNA
tttaacttccagaaataaaagcagccgaaaggctgc

SEQ ID NO: 940 - RNA, 36 nt, synthetic construct
  source 1..36: mol_type = other RNA
agcagctgaacaacatgtcagcagccgaaaggctgc

SEQ ID NO: 941 - RNA, 36 nt, synthetic construct
  source 1..36: mol_type = other RNA
ttgatgcagtttggaaataagcagccgaaaggctgc

SEQ ID NO: 942 - RNA, 36 nt, synthetic construct
  source 1..36: mol_type = other RNA
tgaacaacatgtcatttgcagcagccgaaaggctgc

SEQ ID NO: 943 - RNA, 36 nt, synthetic construct
  source 1..36: mol_type = other RNA
tagtgtaaaaatttatattagcagccgaaaggctgc

SEQ ID NO: 944 - RNA, 36 nt, synthetic construct
  source 1..36: mol_type = other RNA
taactttgtggttccagatagcagccgaaaggctgc

SEQ ID NO: 945 - RNA, 36 nt, synthetic construct
  source 1..36: mol_type = other RNA
aagcagcagctgaacaacaagcagccgaaaggctgc

SEQ ID NO: 946 - RNA, 36 nt, synthetic construct
  source 1..36: mol_type = other RNA
caaaagtgatgaacatggaagcagccgaaaggctgc

SEQ ID NO: 947 - RNA, 22 nt, synthetic construct
  source 1..22: mol_type = other RNA
tgaaatcaaagtcatcctgggg

SEQ ID NO: 948 - RNA, 22 nt, synthetic construct
  source 1..22: mol_type = other RNA
ttgaaatcaaagtcatcctggg

SEQ ID NO: 949 - RNA, 22 nt, synthetic construct
  source 1..22: mol_type = other RNA
tttgaaatcaaagtcatcctgg

SEQ ID NO: 950 - RNA, 22 nt, synthetic construct
  source 1..22: mol_type = other RNA
ttagttgaaatcaaagtcatgg

SEQ ID NO: 951 - RNA, 22 nt, synthetic construct
  source 1..22: mol_type = other RNA
tagattatgaaacaccaaaggg

SEQ ID NO: 952 - RNA, 22 nt, synthetic construct
  source 1..22: mol_type = other RNA
tatagttgaaatcaaagtcagg

SEQ ID NO: 953 - RNA, 22 nt, synthetic construct
  source 1..22: mol_type = other RNA
ttatagttgaaatcaaagtcgg

SEQ ID NO: 954 - RNA, 22 nt, synthetic construct
  source 1..22: mol_type = other RNA
tttgtttccattcagatcttgg

SEQ ID NO: 955 - RNA, 22 nt, synthetic construct
  source 1..22: mol_type = other RNA
tatgacgttatccagttttcgg

SEQ ID NO: 956 - RNA, 22 nt, synthetic construct
  source 1..22: mol_type = other RNA
ttgctaatgacgttatccaggg

SEQ ID NO: 957 - RNA, 22 nt, synthetic construct
  source 1..22: mol_type = other RNA
ttcattaagtttctaaacaggg

SEQ ID NO: 958 - RNA, 22 nt, synthetic construct
  source 1..22: mol_type = other RNA
tcacttttcattaagtttctgg

SEQ ID NO: 959 - RNA, 22 nt, synthetic construct
  source 1..22: mol_type = other RNA
ttcaactcagggaatttgacgg

SEQ ID NO: 960 - RNA, 22 nt, synthetic construct
  source 1..22: mol_type = other RNA
tataattcaactcagggaatgg

SEQ ID NO: 961 - RNA, 22 nt, synthetic construct
  source 1..22: mol_type = other RNA
taagctgataattcaactcagg

SEQ ID NO: 962 - RNA, 22 nt, synthetic construct
  source 1..22: mol_type = other RNA
ttaagctgataattcaactcgg

SEQ ID NO: 963 - RNA, 22 nt, synthetic construct
  source 1..22: mol_type = other RNA
tttaagctgataattcaactgg

SEQ ID NO: 964 - RNA, 22 nt, synthetic construct
  source 1..22: mol_type = other RNA
tattttaagctgataattcagg

SEQ ID NO: 965 - RNA, 22 nt, synthetic construct
  source 1..22: mol_type = other RNA
ttaattttaagctgataattgg

SEQ ID NO: 966 - RNA, 22 nt, synthetic construct
  source 1..22: mol_type = other RNA
tttaattttaagctgataatgg

SEQ ID NO: 967 - RNA, 22 nt, synthetic construct
  source 1..22: mol_type = other RNA
tacactttaattttaagctggg

SEQ ID NO: 968 - RNA, 22 nt, synthetic construct
  source 1..22: mol_type = other RNA
tcacactttaattttaagctgg

SEQ ID NO: 969 - RNA, 22 nt, synthetic construct
  source 1..22: mol_type = other RNA
tacaccctgaataattcacagg

SEQ ID NO: 970 - RNA, 22 nt, synthetic construct
  source 1..22: mol_type = other RNA
tacaaggtcaatgatattgtgg

SEQ ID NO: 971 - RNA, 22 nt, synthetic construct
  source 1..22: mol_type = other RNA
ttcacaaggtcaatgatattgg

SEQ ID NO: 972 - RNA, 22 nt, synthetic construct
  source 1..22: mol_type = other RNA
tttttcacaaggtcaatgatgg

SEQ ID NO: 973 - RNA, 22 nt, synthetic construct
  source 1..22: mol_type = other RNA
tatgatttcagcaaatgacagg

SEQ ID NO: 974 - RNA, 22 nt, synthetic construct
  source 1..22: mol_type = other RNA
tagataaacttggtcttcaggg

SEQ ID NO: 975 - RNA, 22 nt, synthetic construct
  source 1..22: mol_type = other RNA
ttgtcacacagataaacttggg

SEQ ID NO: 976 - RNA, 22 nt, synthetic construct
  source 1..22: mol_type = other RNA
ttcaccattatttccaaactgg

SEQ ID NO: 977 - RNA, 22 nt, synthetic construct
  source 1..22: mol_type = other RNA
tttcactcatttctctatttgg

SEQ ID NO: 978 - RNA, 22 nt, synthetic construct
  source 1..22: mol_type = other RNA
tattcactcatttctctattgg

SEQ ID NO: 979 - RNA, 22 nt, synthetic construct
  source 1..22: mol_type = other RNA
taaaaaatctggaaccacaagg

SEQ ID NO: 980 - RNA, 22 nt, synthetic construct
  source 1..22: mol_type = other RNA
taaaaatctggaaccacaaagg

SEQ ID NO: 981 - RNA, 22 nt, synthetic construct
  source 1..22: mol_type = other RNA
ttccaaactgcatcaatgaagg

SEQ ID NO: 982 - RNA, 22 nt, synthetic construct
  source 1..22: mol_type = other RNA
tttatttccaaactgcatcagg

SEQ ID NO: 983 - RNA, 22 nt, synthetic construct
  source 1..22: mol_type = other RNA
tatttcagcaaatgacatgtgg

SEQ ID NO: 984 - RNA, 22 nt, synthetic construct
  source 1..22: mol_type = other RNA
taaaatctggaaccacaaaggg

SEQ ID NO: 985 - RNA, 22 nt, synthetic construct
  source 1..22: mol_type = other RNA
tacaataatataaatttttagg

SEQ ID NO: 986 - RNA, 22 nt, synthetic construct
  source 1..22: mol_type = other RNA
tttccaaactgcatcaatgagg

SEQ ID NO: 987 - RNA, 22 nt, synthetic construct
  source 1..22: mol_type = other RNA
tccatgatgatttcagcaaagg

SEQ ID NO: 988 - RNA, 22 nt, synthetic construct
  source 1..22: mol_type = other RNA
tagcaaatgacatgttgttcgg

SEQ ID NO: 989 - RNA, 22 nt, synthetic construct
  source 1..22: mol_type = other RNA
ttcagcaaatgacatgttgtgg

SEQ ID NO: 990 - RNA, 22 nt, synthetic construct
  source 1..22: mol_type = other RNA
tcagcaaatgacatgttgttgg

SEQ ID NO: 991 - RNA, 22 nt, synthetic construct
  source 1..22: mol_type = other RNA
tgaaactgcttgattcttcggg

SEQ ID NO: 992 - RNA, 22 nt, synthetic construct
  source 1..22: mol_type = other RNA
tatcaccacaactggcaagggg

SEQ ID NO: 993 - RNA, 22 nt, synthetic construct
  source 1..22: mol_type = other RNA
ttccagtttcttaatttgttgg

SEQ ID NO: 994 - RNA, 22 nt, synthetic construct
  source 1..22: mol_type = other RNA
tactggttgtttccattcaggg

SEQ ID NO: 995 - RNA, 22 nt, synthetic construct
  source 1..22: mol_type = other RNA
ttccattggcttctcaagatgg

SEQ ID NO: 996 - RNA, 22 nt, synthetic construct
  source 1..22: mol_type = other RNA
tagaaactgcttgattcttcgg

SEQ ID NO: 997 - RNA, 22 nt, synthetic construct
  source 1..22: mol_type = other RNA
tagatcaccacaactggcaagg

SEQ ID NO: 998 - RNA, 22 nt, synthetic construct
  source 1..22: mol_type = other RNA
ttggttgtttccattcagatgg

SEQ ID NO: 999 - RNA, 22 nt, synthetic construct
  source 1..22: mol_type = other RNA
tttcattttctgttctagatgg

SEQ ID NO: 1000 - RNA, 22 nt, synthetic construct
  source 1..22: mol_type = other RNA
tattttctgttctagatcctgg

SEQ ID NO: 1001 - RNA, 22 nt, synthetic construct
  source 1..22: mol_type = other RNA
tcacaataatataaatttttgg

SEQ ID NO: 1002 - RNA, 22 nt, synthetic construct
  source 1..22: mol_type = other RNA
tataatataaatttttacacgg

SEQ ID NO: 1003 - RNA, 22 nt, synthetic construct
  source 1..22: mol_type = other RNA
tgaaactttttgctgcaactgg

SEQ ID NO: 1004 - RNA, 22 nt, synthetic construct
  source 1..22: mol_type = other RNA
ttaaaaaagtttacattcttgg

SEQ ID NO: 1005 - RNA, 22 nt, synthetic construct
  source 1..22: mol_type = other RNA
tagaacattcgactcttgcagg

SEQ ID NO: 1006 - RNA, 22 nt, synthetic construct
  source 1..22: mol_type = other RNA
taaactgcatcaatgaatctgg

SEQ ID NO: 1007 - RNA, 22 nt, synthetic construct
  source 1..22: mol_type = other RNA
taaactttttgctgcaactcgg

SEQ ID NO: 1008 - RNA, 22 nt, synthetic construct
  source 1..22: mol_type = other RNA
tctgatagagaacattcgacgg

SEQ ID NO: 1009 - RNA, 22 nt, synthetic construct
  source 1..22: mol_type = other RNA
taaaagtttacattcttggggg

SEQ ID NO: 1010 - RNA, 22 nt, synthetic construct
  source 1..22: mol_type = other RNA
tattcttccatgttcatcacgg

SEQ ID NO: 1011 - RNA, 22 nt, synthetic construct
  source 1..22: mol_type = other RNA
ttagagaacattcgactcttgg

SEQ ID NO: 1012 - RNA, 22 nt, synthetic construct
  source 1..22: mol_type = other RNA
tcaaactgcatcaatgaatcgg

SEQ ID NO: 1013 - RNA, 22 nt, synthetic construct
  source 1..22: mol_type = other RNA
tatagagaacattcgactctgg

SEQ ID NO: 1014 - RNA, 22 nt, synthetic construct
  source 1..22: mol_type = other RNA
ttgatagagaacattcgactgg

SEQ ID NO: 1015 - RNA, 22 nt, synthetic construct
  source 1..22: mol_type = other RNA
tcctgaataattcacaccaggg

SEQ ID NO: 1016 - RNA, 22 nt, synthetic construct
  source 1..22: mol_type = other RNA
taacattcgactcttgcagggg

SEQ ID NO: 1017 - RNA, 22 nt, synthetic construct
  source 1..22: mol_type = other RNA
ttgaatcttagcaggaaggtgg

SEQ ID NO: 1018 - RNA, 22 nt, synthetic construct
  source 1..22: mol_type = other RNA
ttgaataattcacaccaggtgg

SEQ ID NO: 1019 - RNA, 22 nt, synthetic construct
  source 1..22: mol_type = other RNA
tgtaaaaaagtttacattctgg

SEQ ID NO: 1020 - RNA, 22 nt, synthetic construct
  source 1..22: mol_type = other RNA
ttgactttagtagtgaactggg

SEQ ID NO: 1021 - RNA, 22 nt, synthetic construct
  source 1..22: mol_type = other RNA
taaaaaagtttacattcttggg

SEQ ID NO: 1022 - RNA, 22 nt, synthetic construct
  source 1..22: mol_type = other RNA
tgaacattcgactcttgcaggg

SEQ ID NO: 1023 - RNA, 22 nt, synthetic construct
  source 1..22: mol_type = other RNA
taccctgaataattcacaccgg

SEQ ID NO: 1024 - RNA, 22 nt, synthetic construct
  source 1..22: mol_type = other RNA
taaaaagtttacattcttgggg

SEQ ID NO: 1025 - RNA, 22 nt, synthetic construct
  source 1..22: mol_type = other RNA
tatgttgttcagctgctgctgg

SEQ ID NO: 1026 - RNA, 22 nt, synthetic construct
  source 1..22: mol_type = other RNA
taaatgacatgttgttcagcgg

SEQ ID NO: 1027 - RNA, 22 nt, synthetic construct
  source 1..22: mol_type = other RNA
tcaaatgacatgttgttcaggg

SEQ ID NO: 1028 - RNA, 22 nt, synthetic construct
  source 1..22: mol_type = other RNA
tacatgttgttcagctgctggg

SEQ ID NO: 1029 - RNA, 22 nt, synthetic construct
  source 1..22: mol_type = other RNA
ttttatttctggaagttaaagg

SEQ ID NO: 1030 - RNA, 22 nt, synthetic construct
  source 1..22: mol_type = other RNA
tgacatgttgttcagctgctgg

SEQ ID NO: 1031 - RNA, 22 nt, synthetic construct
  source 1..22: mol_type = other RNA
ttatttccaaactgcatcaagg

SEQ ID NO: 1032 - RNA, 22 nt, synthetic construct
  source 1..22: mol_type = other RNA
tgcaaatgacatgttgttcagg

SEQ ID NO: 1033 - RNA, 22 nt, synthetic construct
  source 1..22: mol_type = other RNA
taatataaatttttacactagg

SEQ ID NO: 1034 - RNA, 22 nt, synthetic construct
  source 1..22: mol_type = other RNA
tatctggaaccacaaagttagg

SEQ ID NO: 1035 - RNA, 22 nt, synthetic construct
  source 1..22: mol_type = other RNA
ttgttgttcagctgctgcttgg

SEQ ID NO: 1036 - RNA, 22 nt, synthetic construct
  source 1..22: mol_type = other RNA
ttccatgttcatcacttttggg

SEQ ID NO: 1037 - RNA, 36 nt, synthetic construct; identical to SEQ ID NO: 857
  modified_base 1^2: mod_base = OTHER; note = linked via phosphorothioate
  modified_base 1: mod_base = cm
  modified_base 2: mod_base = cm
  modified_base 3: mod_base = OTHER; note = 2'-O-methyl-adenosine
  modified_base 4: mod_base = gm
  modified_base 5: mod_base = gm
  modified_base 6: mod_base = OTHER; note = 2'-O-methyl-adenosine
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-cytidine
  modified_base 11: mod_base = OTHER; note = 2'-fluoro-uridine
  modified_base 12: mod_base = um
  modified_base 13: mod_base = um
  modified_base 14: mod_base = gm
  modified_base 15: mod_base = OTHER; note = 2'-O-methyl-adenosine
  modified_base 16: mod_base = um
  modified_base 17: mod_base = um
  modified_base 18: mod_base = um
  modified_base 19: mod_base = cm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1038 - RNA, 36 nt, synthetic construct; identical to SEQ ID NO: 858
  modified_base 1^2: mod_base = OTHER; note = linked via phosphorothioate
  modified_base 1: mod_base = cm
  modified_base 2: mod_base = OTHER; note = 2'-O-methyl-adenosine
  modified_base 3: mod_base = gm
  modified_base 4: mod_base = gm
  modified_base 5: mod_base = OTHER; note = 2'-O-methyl-adenosine
  modified_base 6: mod_base = um
  modified_base 7: mod_base = gm
  modified_base 8: mod_base = OTHER; note = 2'-fluoro-adenosine
  modified_base 9: mod_base = OTHER; note = 2'-fluoro-cytidine
  modified_base 10: mod_base = OTHER; note = 2'-fluoro-uridine
  modified_base 11: mod_base = OTHER; note = 2'-fluoro-uridine
  modified_base 12: mod_base = um
  modified_base 13: mod_base = gm
  modified_base 14: mod_base = OTHER; note = 2'-O-methyl-adenosine
  modified_base 15: mod_base = um
  modified_base 16: mod_base = um
  modified_base 17: mod_base = um
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1039 - RNA, 36 nt, synthetic construct; identical to SEQ ID NO: 859
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = gm
  modified_base 4: mod_base = OTHER; note = 2'-O-methyl-adenosine
  modified_base 5: mod_base = um
  modified_base 6: mod_base = gm
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-uridine
  modified_base 12: mod_base = gm
  modified_base 13: mod_base = OTHER; note = 2'-O-methyl-adenosine
  modified_base 14: mod_base = um
  modified_base 15: mod_base = um
  modified_base 16: mod_base = um
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1040 - RNA, 36 nt, synthetic construct; identical to SEQ ID NO: 860
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = gm
  modified_base 4: mod_base = OTHER; note = 2'-O-methyl-adenosine
  modified_base 5: mod_base = cm
  modified_base 6: mod_base = um
  modified_base 7: mod_base = um
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-adenosine
  modified_base 11: mod_base = OTHER; note = 2'-fluoro-uridine
  modified_base 12: mod_base = um
  modified_base 13: mod_base = um
  modified_base 14: mod_base = cm
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1041 - RNA, 36 nt, synthetic construct; identical to SEQ ID NO: 861
  modified_base 1^2: mod_base = OTHER; note = linked via phosphorothioate
  modified_base 1: mod_base = cm
  modified_base 2: mod_base = um
  modified_base 3: mod_base = um
  modified_base 4: mod_base = um
  modified_base 5: mod_base = gm
  modified_base 6: mod_base = gm
  modified_base 7: mod_base = um
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-uridine
  modified_base 12: mod_base = cm
  modified_base 13: mod_base = OTHER; note = 2'-O-methyl-adenosine
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = cm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1042 - RNA, 36 nt, synthetic construct; identical to SEQ ID NO: 862
  modified_base 1^2: mod_base = OTHER; note = linked via phosphorothioate
  modified_base 1: mod_base = um
  modified_base 2: mod_base = gm
  modified_base 3: mod_base = OTHER; note = 2'-O-methyl-adenosine
  modified_base 4: mod_base = cm
  modified_base 5: mod_base = um
  modified_base 6: mod_base = um
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-uridine
  modified_base 12: mod_base = um
  modified_base 13: mod_base = cm
  modified_base 14: mod_base = OTHER; note = 2'-O-methyl-adenosine
  modified_base 15: mod_base = OTHER; note = 2'-O-methyl-adenosine
  modified_base 16: mod_base = cm
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1043 - RNA, 36 nt, synthetic construct; identical to SEQ ID NO: 863
  modified_base 1^2: mod_base = OTHER; note = linked via phosphorothioate
  modified_base 1: mod_base = gm
  modified_base 2: mod_base = OTHER; note = 2'-O-methyl-adenosine
  modified_base 3: mod_base = cm
  modified_base 4: mod_base = um
  modified_base 5: mod_base = um
  modified_base 6: mod_base = um
  modified_base 7: mod_base = gm
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-uridine
  modified_base 12: mod_base = cm
  modified_base 13: mod_base = OTHER; note = 2'-O-methyl-adenosine
  modified_base 14: mod_base = OTHER; note = 2'-O-methyl-adenosine
  modified_base 15: mod_base = cm
  modified_base 16: mod_base = um
  modified_base 17: mod_base = OTHER; note = 2'-O-methyl-adenosine
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1044 - RNA, 36 nt, synthetic construct; identical to SEQ ID NO: 864
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = gm
  modified_base 4: mod_base = OTHER; note = 2'-O-methyl-adenosine
  modified_base 5: mod_base = um
  modified_base 6: mod_base = cm
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = gm
  modified_base 13: mod_base = gm
  modified_base 14: mod_base = OTHER; note = 2'-O-methyl-adenosine
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1045 - RNA, 36 nt, synthetic construct; identical to SEQ ID NO: 865
  modified_base 1^2: mod_base = OTHER; note = linked via phosphorothioate
  modified_base 1: mod_base = gm
  modified_base 2: mod_base = OTHER; note = 2'-O-methyl-adenosine
  modified_base 3: mod_base = OTHER; note = 2'-O-methyl-adenosine
  modified_base 4: mod_base = OTHER; note = 2'-O-methyl-adenosine
  modified_base 5: mod_base = OTHER; note = 2'-O-methyl-adenosine
  modified_base 6: mod_base = cm
  modified_base 7: mod_base = um
  modified_base 8: mod_base = OTHER; note = 2'-fluoro-guanosine
  modified_base 9: mod_base = OTHER; note = 2'-fluoro-guanosine
  modified_base 10: mod_base = OTHER; note = 2'-fluoro-adenosine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = cm
  modified_base 15: mod_base = gm
  modified_base 16: mod_base = um
  modified_base 17: mod_base = cm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1046 - RNA, 36 nt, synthetic construct; identical to SEQ ID NO: 866
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = gm
  modified_base 5: mod_base = OTHER; note = 2'-O-methyl-adenosine
  modified_base 6: mod_base = um
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-cytidine
  modified_base 10: mod_base = OTHER; note = 2'-fluoro-guanosine
  modified_base 11: mod_base = OTHER; note = 2'-fluoro-uridine
  modified_base 12: mod_base = cm
  modified_base 13: mod_base = OTHER; note = 2'-O-methyl-adenosine
  modified_base 14: mod_base = um
  modified_base 15: mod_base = um
  modified_base 16: mod_base = OTHER; note = 2'-O-methyl-adenosine
  modified_base 17: mod_base = gm
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1047 - RNA, 36 nt, synthetic construct; identical to SEQ ID NO: 867
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = um
  modified_base 5: mod_base = um
  modified_base 6: mod_base = um
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-adenosine
  modified_base 12: mod_base = cm
  modified_base 13: mod_base = um
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1048 - RNA, 36 nt, synthetic construct; identical to SEQ ID NO: 868
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = OTHER; note = 2'-O-methyl-adenosine
  modified_base 4: mod_base = OTHER; note = 2'-O-methyl-adenosine
  modified_base 5: mod_base = OTHER; note = 2'-O-methyl-adenosine
  modified_base 6: mod_base = cm
  modified_base 7: mod_base = um
  modified_base 8: mod_base = OTHER; note = 2'-fluoro-uridine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = gm
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = OTHER; note = 2'-O-methyl-adenosine
  modified_base 17: mod_base = gm
  modified_base 18: mod_base = um
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1049 - RNA, 36 nt, synthetic construct; identical to SEQ ID NO: 869
  modified_base 1^2: mod_base = OTHER; note = linked via phosphorothioate
  modified_base 1: mod_base = gm
  modified_base 2: mod_base = um
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-O-methyl-adenosine
  modified_base 7: mod_base = um
  modified_base 8: mod_base = OTHER; note = 2'-fluoro-uridine
  modified_base 9: mod_base = OTHER; note = 2'-fluoro-cytidine
  modified_base 10: mod_base = OTHER; note = 2'-fluoro-cytidine
  modified_base 11: mod_base = OTHER; note = 2'-fluoro-cytidine
  modified_base 12: mod_base = um
  modified_base 13: mod_base = gm
  modified_base 14: mod_base = OTHER; note = 2'-O-methyl-adenosine
  modified_base 15: mod_base = gm
  modified_base 16: mod_base = um
  modified_base 17: mod_base = um
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1050 - RNA, 36 nt, synthetic construct; identical to SEQ ID NO: 870
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = um
  modified_base 4: mod_base = cm
  modified_base 5: mod_base = cm
  modified_base 6: mod_base = cm
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-guanosine
  modified_base 11: mod_base = OTHER; note = 2'-fluoro-uridine
  modified_base 12: mod_base = um
  modified_base 13: mod_base = gm
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1051 - RNA, 36 nt, synthetic construct; identical to SEQ ID NO: 29
  modified_base 1^2: mod_base = OTHER; note = linked via phosphorothioate
  modified_base 1: mod_base = um
  modified_base 2: mod_base = gm
  modified_base 3: mod_base = OTHER; note = 2'-O-methyl-adenosine
  modified_base 4: mod_base = gm
  modified_base 5: mod_base = um
  modified_base 6: mod_base = um
  modified_base 7: mod_base = gm
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-uridine
  modified_base 12: mod_base = OTHER; note = 2'-O-methyl-adenosine
  modified_base 13: mod_base = um
  modified_base 14: mod_base = cm
  modified_base 15: mod_base = OTHER; note = 2'-O-methyl-adenosine
  modified_base 16: mod_base = gm
  modified_base 17: mod_base = cm
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1052 - RNA, 36 nt, synthetic construct; identical to SEQ ID NO: 33
  modified_base 1^2: mod_base = OTHER; note = linked via phosphorothioate
  modified_base 1: mod_base = gm
  modified_base 2: mod_base = OTHER; note = 2'-O-methyl-adenosine
  modified_base 3: mod_base = gm
  modified_base 4: mod_base = um
  modified_base 5: mod_base = um
  modified_base 6: mod_base = gm
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-adenosine
  modified_base 12: mod_base = um
  modified_base 13: mod_base = cm
  modified_base 14: mod_base = OTHER; note = 2'-O-methyl-adenosine
  modified_base 15: mod_base = gm
  modified_base 16: mod_base = cm
  modified_base 17: mod_base = um
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1053 - RNA, 36 nt, synthetic construct; identical to SEQ ID NO: 37
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = um
  modified_base 5: mod_base = gm
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-adenosine
  modified_base 11: mod_base = OTHER; note = 2'-fluoro-uridine
  modified_base 12: mod_base = cm
  modified_base 13: mod_base = OTHER; note = 2'-O-methyl-adenosine
  modified_base 14: mod_base = gm
  modified_base 15: mod_base = cm
  modified_base 16: mod_base = um
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1054 - RNA, 36 nt, synthetic construct; identical to SEQ ID NO: 874
  modified_base 1^2: mod_base = OTHER; note = linked via phosphorothioate
  modified_base 1: mod_base = um
  modified_base 2: mod_base = gm
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = um
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-cytidine
  modified_base 10: mod_base = OTHER; note = 2'-fluoro-adenosine
  modified_base 11: mod_base = OTHER; note = 2'-fluoro-guanosine
  modified_base 12: mod_base = cm
  modified_base 13: mod_base = um
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1055 - RNA, 36 nt, synthetic construct; identical to SEQ ID NO: 875
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = um
  modified_base 4: mod_base = um
  modified_base 5: mod_base = OTHER; note = 2'-O-methyl-adenosine
  modified_base 6: mod_base = um
  modified_base 7: mod_base = cm
  modified_base 8: mod_base = OTHER; note = 2'-fluoro-adenosine
  modified_base 9: mod_base = OTHER; note = 2'-fluoro-guanosine
  modified_base 10: mod_base = OTHER; note = 2'-fluoro-cytidine
  modified_base 11: mod_base = OTHER; note = 2'-fluoro-uridine
  modified_base 12: mod_base = um
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1056 - RNA, 36 nt, synthetic construct; identical to SEQ ID NO: 876
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = um
  modified_base 4: mod_base = OTHER; note = 2'-O-methyl-adenosine
  modified_base 5: mod_base = um
  modified_base 6: mod_base = cm
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-cytidine
  modified_base 10: mod_base = OTHER; note = 2'-fluoro-uridine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1057 - RNA, 36 nt, synthetic construct; identical to SEQ ID NO: 877
  modified_base 1^2: mod_base = OTHER; note = linked via phosphorothioate
  modified_base 1: mod_base = cm
  modified_base 2: mod_base = OTHER; note = 2'-O-methyl-adenosine
  modified_base 3: mod_base = gm
  modified_base 4: mod_base = cm
  modified_base 5: mod_base = um
  modified_base 6: mod_base = um
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = um
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = gm
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1058 - RNA, 36 nt, synthetic construct; identical to SEQ ID NO: 878
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = cm
  modified_base 4: mod_base = um
  modified_base 5: mod_base = um
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-O-methyl-adenosine
  modified_base 15: mod_base = gm
  modified_base 16: mod_base = um
  modified_base 17: mod_base = gm
  modified_base 18: mod_base = um
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1059 - RNA, 36 nt, synthetic construct; identical to SEQ ID NO: 879
  modified_base 1^2: mod_base = OTHER; note = linked via phosphorothioate
  modified_base 1: mod_base = um
  modified_base 2: mod_base = gm
  modified_base 3: mod_base = um
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = um
  modified_base 8: mod_base = OTHER; note = 2'-fluoro-uridine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-uridine
  modified_base 12: mod_base = cm
  modified_base 13: mod_base = OTHER; note = 2'-O-methyl-adenosine
  modified_base 14: mod_base = gm
  modified_base 15: mod_base = gm
  modified_base 16: mod_base = gm
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1060 - RNA, 36 nt, synthetic construct; identical to SEQ ID NO: 880
  modified_base 1^2: mod_base = OTHER; note = linked via phosphorothioate
  modified_base 1: mod_base = OTHER; note = 2'-O-methyl-adenosine
  modified_base 2: mod_base = cm
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-O-methyl-adenosine
  modified_base 7: mod_base = um
  modified_base 8: mod_base = OTHER; note = 2'-fluoro-cytidine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-uridine
  modified_base 12: mod_base = gm
  modified_base 13: mod_base = OTHER; note = 2'-O-methyl-adenosine
  modified_base 14: mod_base = cm
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1061 - RNA, 36 nt, synthetic construct; identical to SEQ ID NO: 881
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = um
  modified_base 4: mod_base = OTHER; note = 2'-O-methyl-adenosine
  modified_base 5: mod_base = um
  modified_base 6: mod_base = cm
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-adenosine
  modified_base 12: mod_base = cm
  modified_base 13: mod_base = cm
  modified_base 14: mod_base = um
  modified_base 15: mod_base = um
  modified_base 16: mod_base = gm
  modified_base 17: mod_base = um
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1062 - RNA, 36 nt, synthetic construct; identical to SEQ ID NO: 882
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = cm
  modified_base 4: mod_base = OTHER; note = 2'-O-methyl-adenosine
  modified_base 5: mod_base = um
  modified_base 6: mod_base = um
  modified_base 7: mod_base = gm
  modified_base 8: mod_base = OTHER; note = 2'-fluoro-adenosine
  modified_base 9: mod_base = OTHER; note = 2'-fluoro-cytidine
  modified_base 10: mod_base = OTHER; note = 2'-fluoro-cytidine
  modified_base 11: mod_base = OTHER; note = 2'-fluoro-uridine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1063 - RNA, 36 nt, synthetic construct; identical to SEQ ID NO: 883
  modified_base 1^2: mod_base = OTHER; note = linked via phosphorothioate
  modified_base 1: mod_base = um
  modified_base 2: mod_base = gm
  modified_base 3: mod_base = um
  modified_base 4: mod_base = cm
  modified_base 5: mod_base = OTHER; note = 2'-O-methyl-adenosine
  modified_base 6: mod_base = um
  modified_base 7: mod_base = um
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-cytidine
  modified_base 11: mod_base = OTHER; note = 2'-fluoro-uridine
  modified_base 12: mod_base = gm
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = cm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1064 - RNA, 36 nt, synthetic construct; identical to SEQ ID NO: 884
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = OTHER; note = 2'-O-methyl-adenosine
  modified_base 5: mod_base = OTHER; note = 2'-O-methyl-adenosine
  modified_base 6: mod_base = gm
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-cytidine
  modified_base 10: mod_base = OTHER; note = 2'-fluoro-adenosine
  modified_base 11: mod_base = OTHER; note = 2'-fluoro-adenosine
  modified_base 12: mod_base = gm
  modified_base 13: mod_base = um
  modified_base 14: mod_base = um
  modified_base 15: mod_base = um
  modified_base 16: mod_base = OTHER; note = 2'-O-methyl-adenosine
  modified_base 17: mod_base = um
  modified_base 18: mod_base = cm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1065 - RNA, 36 nt, synthetic construct; identical to SEQ ID NO: 885
  modified_base 1^2: mod_base = OTHER; note = linked via phosphorothioate
  modified_base 1: mod_base = cm
  modified_base 2: mod_base = OTHER; note = 2'-O-methyl-adenosine
  modified_base 3: mod_base = OTHER; note = 2'-O-methyl-adenosine
  modified_base 4: mod_base = gm
  modified_base 5: mod_base = um
  modified_base 6: mod_base = um
  modified_base 7: mod_base = um
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-cytidine
  modified_base 11: mod_base = OTHER; note = 2'-fluoro-uridine
  modified_base 12: mod_base = gm
  modified_base 13: mod_base = um
  modified_base 14: mod_base = gm
  modified_base 15: mod_base = um
  modified_base 16: mod_base = gm
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1066 - RNA, 36 nt, synthetic construct; identical to SEQ ID NO: 886
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = um
  modified_base 5: mod_base = um
  modified_base 6: mod_base = gm
  modified_base 7: mod_base = gm
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = um
  modified_base 15: mod_base = gm
  modified_base 16: mod_base = gm
  modified_base 17: mod_base = um
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1067 - RNA, 36 nt, synthetic construct; identical to SEQ ID NO: 887
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = OTHER; note = 2'-O-methyl-adenosine
  modified_base 4: mod_base = um
  modified_base 5: mod_base = OTHER; note = 2'-O-methyl-adenosine
  modified_base 6: mod_base = gm
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-adenosine
  modified_base 12: mod_base = um
  modified_base 13: mod_base = gm
  modified_base 14: mod_base = OTHER; note = 2'-O-methyl-adenosine
  modified_base 15: mod_base = gm
  modified_base 16: mod_base = um
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1068 - RNA, 36 nt, synthetic construct; identical to SEQ ID NO: 888
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = um
  modified_base 4: mod_base = OTHER; note = 2'-O-methyl-adenosine
  modified_base 5: mod_base = gm
  modified_base 6: mod_base = OTHER; note = 2'-O-methyl-adenosine
  modified_base 7: mod_base = gm
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = gm
  modified_base 13: mod_base = OTHER; note = 2'-O-methyl-adenosine
  modified_base 14: mod_base = gm
  modified_base 15: mod_base = um
  modified_base 16: mod_base = gm
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1069 - RNA, 36 nt, synthetic construct; identical to SEQ ID NO: 889
  modified_base 1^2: mod_base = OTHER; note = linked via phosphorothioate
  modified_base 1: mod_base = um
  modified_base 2: mod_base = um
  modified_base 3: mod_base = gm
  modified_base 4: mod_base = um
  modified_base 5: mod_base = gm
  modified_base 6: mod_base = gm
  modified_base 7: mod_base = um
  modified_base 8: mod_base = OTHER; note = 2'-fluoro-uridine
  modified_base 9: mod_base = OTHER; note = 2'-fluoro-cytidine
  modified_base 10: mod_base = OTHER; note = 2'-fluoro-cytidine
  modified_base 11: mod_base = OTHER; note = 2'-fluoro-adenosine
  modified_base 12: mod_base = gm
  modified_base 13: mod_base = OTHER; note = 2'-O-methyl-adenosine
  modified_base 14: mod_base = um
  modified_base 15: mod_base = um
  modified_base 16: mod_base = um
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1070 - RNA, 36 nt, synthetic construct; identical to SEQ ID NO: 890
  modified_base 1^2: mod_base = OTHER; note = linked via phosphorothioate
  modified_base 1: mod_base = um
  modified_base 2: mod_base = um
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-cytidine
  modified_base 11: mod_base = OTHER; note = 2'-fluoro-cytidine
  modified_base 12: mod_base = OTHER; note = 2'-O-methyl-adenosine
  modified_base 13: mod_base = gm
  modified_base 14: mod_base = OTHER; note = 2'-O-methyl-adenosine
  modified_base 15: mod_base = um
  modified_base 16: mod_base = um
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1071 - RNA, 36 nt, synthetic construct; identical to SEQ ID NO: 891
  modified_base 1^2: mod_base = OTHER; note = linked via phosphorothioate
  modified_base 1: mod_base = um
  modified_base 2: mod_base = um
  modified_base 3: mod_base = cm
  modified_base 4: mod_base = OTHER; note = 2'-O-methyl-adenosine
  modified_base 5: mod_base = um
  modified_base 6: mod_base = um
  modified_base 7: mod_base = gm
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-cytidine
  modified_base 12: mod_base = OTHER; note = 2'-O-methyl-adenosine
  modified_base 13: mod_base = gm
  modified_base 14: mod_base = um
  modified_base 15: mod_base = um
  modified_base 16: mod_base = um
  modified_base 17: mod_base = gm
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1072 - RNA, 36 nt, synthetic construct; identical to SEQ ID NO: 892
  modified_base 1^2: mod_base = OTHER; note = linked via phosphorothioate
  modified_base 1: mod_base = um
  modified_base 2: mod_base = gm
  modified_base 3: mod_base = OTHER; note = 2'-O-methyl-adenosine
  modified_base 4: mod_base = um
  modified_base 5: mod_base = gm
  modified_base 6: mod_base = cm
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-uridine
  modified_base 12: mod_base = gm
  modified_base 13: mod_base = gm
  modified_base 14: mod_base = OTHER; note = 2'-O-methyl-adenosine
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1073 - RNA, 36 nt, synthetic construct; identical to SEQ ID NO: 893
  modified_base 1^2: mod_base = OTHER; note = linked via phosphorothioate
  modified_base 1: mod_base = OTHER; note = 2'-O-methyl-adenosine
  modified_base 2: mod_base = cm
  modified_base 3: mod_base = OTHER; note = 2'-O-methyl-adenosine
  modified_base 4: mod_base = um
  modified_base 5: mod_base = gm
  modified_base 6: mod_base = um
  modified_base 7: mod_base = cm
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-uridine
  modified_base 12: mod_base = gm
  modified_base 13: mod_base = cm
  modified_base 14: mod_base = um
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1074 - RNA, 36 nt, synthetic construct; identical to SEQ ID NO: 894
  modified_base 1^2: mod_base = OTHER; note = linked via phosphorothioate
  modified_base 1: mod_base = cm
  modified_base 2: mod_base = um
  modified_base 3: mod_base = um
  modified_base 4: mod_base = um
  modified_base 5: mod_base = gm
  modified_base 6: mod_base = um
  modified_base 7: mod_base = gm
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-cytidine
  modified_base 12: mod_base = cm
  modified_base 13: mod_base = OTHER; note = 2'-O-methyl-adenosine
  modified_base 14: mod_base = gm
  modified_base 15: mod_base = OTHER; note = 2'-O-methyl-adenosine
  modified_base 16: mod_base = um
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1075 - RNA, 36 nt, synthetic construct; identical to SEQ ID NO: 895
  modified_base 1^2: mod_base = OTHER; note = linked via phosphorothioate
  modified_base 1: mod_base = um
  modified_base 2: mod_base = OTHER; note = 2'-O-methyl-adenosine
  modified_base 3: mod_base = OTHER; note = 2'-O-methyl-adenosine
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-O-methyl-adenosine
  modified_base 7: mod_base = um
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-adenosine
  modified_base 11: mod_base = OTHER; note = 2'-fluoro-uridine
  modified_base 12: mod_base = OTHER; note = 2'-O-methyl-adenosine
  modified_base 13: mod_base = um
  modified_base 14: mod_base = um
  modified_base 15: mod_base = OTHER; note = 2'-O-methyl-adenosine
  modified_base 16: mod_base = um
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1076 - RNA, 36 nt, synthetic construct; identical to SEQ ID NO: 896
  modified_base 1^2: mod_base = OTHER; note = linked via phosphorothioate
  modified_base 1: mod_base = um
  modified_base 2: mod_base = cm
  modified_base 3: mod_base = OTHER; note = 2'-O-methyl-adenosine
  modified_base 4: mod_base = um
  modified_base 5: mod_base = um
  modified_base 6: mod_base = gm
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-cytidine
  modified_base 11: mod_base = OTHER; note = 2'-fluoro-adenosine
  modified_base 12: mod_base = gm
  modified_base 13: mod_base = um
  modified_base 14: mod_base = um
  modified_base 15: mod_base = um
  modified_base 16: mod_base = gm
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1077 - RNA, 36 nt, synthetic construct; identical to SEQ ID NO: 897
  modified_base 1^2: mod_base = OTHER; note = linked via phosphorothioate
  modified_base 1: mod_base = um
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = gm
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = cm
  modified_base 13: mod_base = OTHER; note = 2'-O-methyl-adenosine
  modified_base 14: mod_base = um
  modified_base 15: mod_base = cm
  modified_base 16: mod_base = OTHER; note = 2'-O-methyl-adenosine
  modified_base 17: mod_base = um
  modified_base 18: mod_base = gm
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1078 - RNA, 36 nt, synthetic construct; identical to SEQ ID NO: 898
  modified_base 1^2: mod_base = OTHER; note = linked via phosphorothioate
  modified_base 1: mod_base = gm
  modified_base 2: mod_base = OTHER; note = 2'-O-methyl-adenosine
  modified_base 3: mod_base = OTHER; note = 2'-O-methyl-adenosine
  modified_base 4: mod_base = cm
  modified_base 5: mod_base = OTHER; note = 2'-O-methyl-adenosine
  modified_base 6: mod_base = OTHER; note = 2'-O-methyl-adenosine
  modified_base 7: mod_base = cm
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-uridine
  modified_base 12: mod_base = cm
  modified_base 13: mod_base = OTHER; note = 2'-O-methyl-adenosine
  modified_base 14: mod_base = um
  modified_base 15: mod_base = um
  modified_base 16: mod_base = um
  modified_base 17: mod_base = gm
  modified_base 18: mod_base = cm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1079 - RNA, 36 nt, synthetic construct; identical to SEQ ID NO: 899
  modified_base 1^2: mod_base = OTHER; note = linked via phosphorothioate
  modified_base 1: mod_base = OTHER; note = 2'-O-methyl-adenosine
  modified_base 2: mod_base = cm
  modified_base 3: mod_base = OTHER; note = 2'-O-methyl-adenosine
  modified_base 4: mod_base = OTHER; note = 2'-O-methyl-adenosine
  modified_base 5: mod_base = cm
  modified_base 6: mod_base = OTHER; note = 2'-O-methyl-adenosine
  modified_base 7: mod_base = um
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-cytidine
  modified_base 11: mod_base = OTHER; note = 2'-fluoro-adenosine
  modified_base 12: mod_base = um
  modified_base 13: mod_base = um
  modified_base 14: mod_base = um
  modified_base 15: mod_base = gm
  modified_base 16: mod_base = cm
  modified_base 17: mod_base = um
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1080 - RNA, 36 nt, synthetic construct; identical to SEQ ID NO: 900
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = cm
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-uridine
  modified_base 11: mod_base = OTHER; note = 2'-fluoro-cytidine
  modified_base 12: mod_base = OTHER; note = 2'-O-methyl-adenosine
  modified_base 13: mod_base = um
  modified_base 14: mod_base = um
  modified_base 15: mod_base = um
  modified_base 16: mod_base = gm
  modified_base 17: mod_base = cm
  modified_base 18: mod_base = um
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1081 - RNA, 36 nt, synthetic construct; identical to SEQ ID NO: 901
  modified_base 1^2: mod_base = OTHER; note = linked via phosphorothioate
  modified_base 1: mod_base = cm
  modified_base 2: mod_base = gm
  modified_base 3: mod_base = OTHER; note = 2'-O-methyl-adenosine
  modified_base 4: mod_base = OTHER; note = 2'-O-methyl-adenosine
  modified_base 5: mod_base = gm
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-cytidine
  modified_base 10: mod_base = OTHER; note = 2'-fluoro-adenosine
  modified_base 11: mod_base = OTHER; note = 2'-fluoro-adenosine
  modified_base 12: mod_base = gm
  modified_base 13: mod_base = cm
  modified_base 14: mod_base = OTHER; note = 2'-O-methyl-adenosine
  modified_base 15: mod_base = gm
  modified_base 16: mod_base = um
  modified_base 17: mod_base = um
  modified_base 18: mod_base = um
  modified_base 19: mod_base = cm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1082 - RNA, 36 nt, synthetic construct; identical to SEQ ID NO: 902
  modified_base 1^2: mod_base = OTHER; note = linked via phosphorothioate
  modified_base 1: mod_base = cm
  modified_base 2: mod_base = cm
  modified_base 3: mod_base = um
  modified_base 4: mod_base = um
  modified_base 5: mod_base = gm
  modified_base 6: mod_base = cm
  modified_base 7: mod_base = cm
  modified_base 8: mod_base = OTHER; note = 2'-fluoro-adenosine
  modified_base 9: mod_base = OTHER; note = 2'-fluoro-guanosine
  modified_base 10: mod_base = OTHER; note = 2'-fluoro-uridine
  modified_base 11: mod_base = OTHER; note = 2'-fluoro-uridine
  modified_base 12: mod_base = gm
  modified_base 13: mod_base = um
  modified_base 14: mod_base = gm
  modified_base 15: mod_base = gm
  modified_base 16: mod_base = um
  modified_base 17: mod_base = gm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1083 - RNA, 36 nt, synthetic construct; identical to SEQ ID NO: 903
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-O-methyl-adenosine
  modified_base 7: mod_base = um
  modified_base 8: mod_base = OTHER; note = 2'-fluoro-uridine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-guanosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-O-methyl-adenosine
  modified_base 15: mod_base = cm
  modified_base 16: mod_base = um
  modified_base 17: mod_base = gm
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1084 - RNA, 36 nt, synthetic construct; identical to SEQ ID NO: 904
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = gm
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-adenosine
  modified_base 12: mod_base = cm
  modified_base 13: mod_base = OTHER; note = 2'-O-methyl-adenosine
  modified_base 14: mod_base = OTHER; note = 2'-O-methyl-adenosine
  modified_base 15: mod_base = cm
  modified_base 16: mod_base = cm
  modified_base 17: mod_base = OTHER; note = 2'-O-methyl-adenosine
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1085 - RNA, 36 nt, synthetic construct; identical to SEQ ID NO: 905
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = cm
  modified_base 4: mod_base = um
  modified_base 5: mod_base = um
  modified_base 6: mod_base = gm
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-guanosine
  modified_base 12: mod_base = cm
  modified_base 13: mod_base = cm
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = gm
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1086 - RNA, 36 nt, synthetic construct; identical to SEQ ID NO: 906
  modified_base 1^2: mod_base = OTHER; note = linked via phosphorothioate
  modified_base 1: mod_base = gm
  modified_base 2: mod_base = OTHER; note = 2'-O-methyl-adenosine
  modified_base 3: mod_base = OTHER; note = 2'-O-methyl-adenosine
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = um
  modified_base 8: mod_base = OTHER; note = 2'-fluoro-cytidine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-guanosine
  modified_base 12: mod_base = cm
  modified_base 13: mod_base = OTHER; note = 2'-O-methyl-adenosine
  modified_base 14: mod_base = gm
  modified_base 15: mod_base = um
  modified_base 16: mod_base = um
  modified_base 17: mod_base = um
  modified_base 18: mod_base = cm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1087 - RNA, 36 nt, synthetic construct; identical to SEQ ID NO: 907
  modified_base 1^2: mod_base = OTHER; note = linked via phosphorothioate
  modified_base 1: mod_base = um
  modified_base 2: mod_base = um
  modified_base 3: mod_base = gm
  modified_base 4: mod_base = cm
  modified_base 5: mod_base = cm
  modified_base 6: mod_base = OTHER; note = 2'-O-methyl-adenosine
  modified_base 7: mod_base = gm
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-uridine
  modified_base 12: mod_base = gm
  modified_base 13: mod_base = gm
  modified_base 14: mod_base = um
  modified_base 15: mod_base = gm
  modified_base 16: mod_base = OTHER; note = 2'-O-methyl-adenosine
  modified_base 17: mod_base = um
  modified_base 18: mod_base = cm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1088 - RNA, 36 nt, synthetic construct; identical to SEQ ID NO: 908
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = cm
  modified_base 4: mod_base = um
  modified_base 5: mod_base = gm
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-guanosine
  modified_base 11: mod_base = OTHER; note = 2'-fluoro-adenosine
  modified_base 12: mod_base = OTHER; note = 2'-O-methyl-adenosine
  modified_base 13: mod_base = OTHER; note = 2'-O-methyl-adenosine
  modified_base 14: mod_base = cm
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1089 - RNA, 36 nt, synthetic construct; identical to SEQ ID NO: 909
  modified_base 1^2: mod_base = OTHER; note = linked via phosphorothioate
  modified_base 1: mod_base = OTHER; note = 2'-O-methyl-adenosine
  modified_base 2: mod_base = um
  modified_base 3: mod_base = cm
  modified_base 4: mod_base = um
  modified_base 5: mod_base = OTHER; note = 2'-O-methyl-adenosine
  modified_base 6: mod_base = gm
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-cytidine
  modified_base 10: mod_base = OTHER; note = 2'-fluoro-adenosine
  modified_base 11: mod_base = OTHER; note = 2'-fluoro-guanosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1090 - RNA, 36 nt, synthetic construct; identical to SEQ ID NO: 910
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = gm
  modified_base 4: mod_base = OTHER; note = 2'-O-methyl-adenosine
  modified_base 5: mod_base = um
  modified_base 6: mod_base = cm
  modified_base 7: mod_base = um
  modified_base 8: mod_base = OTHER; note = 2'-fluoro-adenosine
  modified_base 9: mod_base = OTHER; note = 2'-fluoro-guanosine
  modified_base 10: mod_base = OTHER; note = 2'-fluoro-adenosine
  modified_base 11: mod_base = OTHER; note = 2'-fluoro-adenosine
  modified_base 12: mod_base = cm
  modified_base 13: mod_base = OTHER; note = 2'-O-methyl-adenosine
  modified_base 14: mod_base = gm
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1091 - RNA, 36 nt, synthetic construct; identical to SEQ ID NO: 911
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = OTHER; note = 2'-O-methyl-adenosine
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = um
  modified_base 8: mod_base = OTHER; note = 2'-fluoro-uridine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-adenosine
  modified_base 12: mod_base = um
  modified_base 13: mod_base = um
  modified_base 14: mod_base = OTHER; note = 2'-O-methyl-adenosine
  modified_base 15: mod_base = um
  modified_base 16: mod_base = um
  modified_base 17: mod_base = gm
  modified_base 18: mod_base = um
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1092 - RNA, 36 nt, synthetic construct; identical to SEQ ID NO: 912
  modified_base 1^2: mod_base = OTHER; note = linked via phosphorothioate
  modified_base 1: mod_base = gm
  modified_base 2: mod_base = um
  modified_base 3: mod_base = gm
  modified_base 4: mod_base = um
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-uridine
  modified_base 12: mod_base = um
  modified_base 13: mod_base = OTHER; note = 2'-O-methyl-adenosine
  modified_base 14: mod_base = um
  modified_base 15: mod_base = OTHER; note = 2'-O-methyl-adenosine
  modified_base 16: mod_base = um
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1093 - RNA, 36 nt, synthetic construct; identical to SEQ ID NO: 913
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = um
  modified_base 5: mod_base = gm
  modified_base 6: mod_base = cm
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-cytidine
  modified_base 10: mod_base = OTHER; note = 2'-fluoro-adenosine
  modified_base 11: mod_base = OTHER; note = 2'-fluoro-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-O-methyl-adenosine
  modified_base 15: mod_base = gm
  modified_base 16: mod_base = um
  modified_base 17: mod_base = um
  modified_base 18: mod_base = um
  modified_base 19: mod_base = cm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1094 - RNA, 36 nt, synthetic construct; identical to SEQ ID NO: 914
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = gm
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = gm
  modified_base 8: mod_base = OTHER; note = 2'-fluoro-uridine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-adenosine
  modified_base 12: mod_base = cm
  modified_base 13: mod_base = um
  modified_base 14: mod_base = um
  modified_base 15: mod_base = um
  modified_base 16: mod_base = um
  modified_base 17: mod_base = um
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1095 - RNA, 36 nt, synthetic construct; identical to SEQ ID NO: 915
  modified_base 1^2: mod_base = OTHER; note = linked via phosphorothioate
  modified_base 1: mod_base = um
  modified_base 2: mod_base = gm
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = gm
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-cytidine
  modified_base 11: mod_base = OTHER; note = 2'-fluoro-guanosine
  modified_base 12: mod_base = OTHER; note = 2'-O-methyl-adenosine
  modified_base 13: mod_base = OTHER; note = 2'-O-methyl-adenosine
  modified_base 14: mod_base = um
  modified_base 15: mod_base = gm
  modified_base 16: mod_base = um
  modified_base 17: mod_base = um
  modified_base 18: mod_base = cm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1096 - RNA, 36 nt, synthetic construct; identical to SEQ ID NO: 916
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = OTHER; note = 2'-O-methyl-adenosine
  modified_base 4: mod_base = um
  modified_base 5: mod_base = um
  modified_base 6: mod_base = cm
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-adenosine
  modified_base 12: mod_base = um
  modified_base 13: mod_base = gm
  modified_base 14: mod_base = cm
  modified_base 15: mod_base = OTHER; note = 2'-O-methyl-adenosine
  modified_base 16: mod_base = gm
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1097 - RNA, 36 nt, synthetic construct; identical to SEQ ID NO: 917
  modified_base 1^2: mod_base = OTHER; note = linked via phosphorothioate
  modified_base 1: mod_base = gm
  modified_base 2: mod_base = OTHER; note = 2'-O-methyl-adenosine
  modified_base 3: mod_base = gm
  modified_base 4: mod_base = um
  modified_base 5: mod_base = um
  modified_base 6: mod_base = gm
  modified_base 7: mod_base = cm
  modified_base 8: mod_base = OTHER; note = 2'-fluoro-adenosine
  modified_base 9: mod_base = OTHER; note = 2'-fluoro-guanosine
  modified_base 10: mod_base = OTHER; note = 2'-fluoro-cytidine
  modified_base 11: mod_base = OTHER; note = 2'-fluoro-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = gm
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1098 - RNA, 36 nt, synthetic construct; identical to SEQ ID NO: 918
  modified_base 1^2: mod_base = OTHER; note = linked via phosphorothioate
  modified_base 1: mod_base = gm
  modified_base 2: mod_base = um
  modified_base 3: mod_base = cm
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = um
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-cytidine
  modified_base 12: mod_base = um
  modified_base 13: mod_base = cm
  modified_base 14: mod_base = um
  modified_base 15: mod_base = OTHER; note = 2'-O-methyl-adenosine
  modified_base 16: mod_base = um
  modified_base 17: mod_base = cm
  modified_base 18: mod_base = OTHER; note = 2'-O-methyl-adenosine
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1099 - RNA, 36 nt, synthetic construct; identical to SEQ ID NO: 919
  modified_base 1^2: mod_base = OTHER; note = linked via phosphorothioate
  modified_base 1: mod_base = cm
  modified_base 2: mod_base = cm
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = gm
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-O-methyl-adenosine
  modified_base 15: mod_base = cm
  modified_base 16: mod_base = um
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1100 - RNA, 36 nt, synthetic construct; identical to SEQ ID NO: 920
  modified_base 1^2: mod_base = OTHER; note = linked via phosphorothioate
  modified_base 1: mod_base = gm
  modified_base 2: mod_base = um
  modified_base 3: mod_base = gm
  modified_base 4: mod_base = OTHER; note = 2'-O-methyl-adenosine
  modified_base 5: mod_base = um
  modified_base 6: mod_base = gm
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-cytidine
  modified_base 10: mod_base = OTHER; note = 2'-fluoro-adenosine
  modified_base 11: mod_base = OTHER; note = 2'-fluoro-uridine
  modified_base 12: mod_base = gm
  modified_base 13: mod_base = gm
  modified_base 14: mod_base = OTHER; note = 2'-O-methyl-adenosine
  modified_base 15: mod_base = OTHER; note = 2'-O-methyl-adenosine
  modified_base 16: mod_base = gm
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1101 - RNA, 36 nt, synthetic construct; identical to SEQ ID NO: 921
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = gm
  modified_base 4: mod_base = OTHER; note = 2'-O-methyl-adenosine
  modified_base 5: mod_base = gm
  modified_base 6: mod_base = um
  modified_base 7: mod_base = cm
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = gm
  modified_base 13: mod_base = um
  modified_base 14: mod_base = um
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1102 - RNA, 36 nt, synthetic construct; identical to SEQ ID NO: 922
  modified_base 1^2: mod_base = OTHER; note = linked via phosphorothioate
  modified_base 1: mod_base = gm
  modified_base 2: mod_base = OTHER; note = 2'-O-methyl-adenosine
  modified_base 3: mod_base = um
  modified_base 4: mod_base = um
  modified_base 5: mod_base = cm
  modified_base 6: mod_base = OTHER; note = 2'-O-methyl-adenosine
  modified_base 7: mod_base = um
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-adenosine
  modified_base 11: mod_base = OTHER; note = 2'-fluoro-uridine
  modified_base 12: mod_base = gm
  modified_base 13: mod_base = cm
  modified_base 14: mod_base = OTHER; note = 2'-O-methyl-adenosine
  modified_base 15: mod_base = gm
  modified_base 16: mod_base = um
  modified_base 17: mod_base = um
  modified_base 18: mod_base = um
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1103 - RNA, 36 nt, synthetic construct; identical to SEQ ID NO: 923
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = OTHER; note = 2'-O-methyl-adenosine
  modified_base 4: mod_base = gm
  modified_base 5: mod_base = um
  modified_base 6: mod_base = cm
  modified_base 7: mod_base = gm
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-guanosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1104 - RNA, 36 nt, synthetic construct; identical to SEQ ID NO: 924
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = um
  modified_base 4: mod_base = cm
  modified_base 5: mod_base = gm
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-uridine
  modified_base 11: mod_base = OTHER; note = 2'-fluoro-uridine
  modified_base 12: mod_base = cm
  modified_base 13: mod_base = um
  modified_base 14: mod_base = cm
  modified_base 15: mod_base = um
  modified_base 16: mod_base = OTHER; note = 2'-O-methyl-adenosine
  modified_base 17: mod_base = um
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1105 - RNA, 36 nt, synthetic construct; identical to SEQ ID NO: 925
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = gm
  modified_base 5: mod_base = um
  modified_base 6: mod_base = gm
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-uridine
  modified_base 12: mod_base = um
  modified_base 13: mod_base = OTHER; note = 2'-O-methyl-adenosine
  modified_base 14: mod_base = um
  modified_base 15: mod_base = um
  modified_base 16: mod_base = cm
  modified_base 17: mod_base = OTHER; note = 2'-O-methyl-adenosine
  modified_base 18: mod_base = gm
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1106 - RNA, 36 nt, synthetic construct; identical to SEQ ID NO: 926
  modified_base 1^2: mod_base = OTHER; note = linked via phosphorothioate
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-guanosine
  modified_base 11: mod_base = OTHER; note = 2'-fluoro-uridine
  modified_base 12: mod_base = cm
  modified_base 13: mod_base = gm
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = gm
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1107 - RNA, 36 nt, synthetic construct; identical to SEQ ID NO: 927
  modified_base 1^2: mod_base = OTHER; note = linked via phosphorothioate
  modified_base 1: mod_base = OTHER; note = 2'-O-methyl-adenosine
  modified_base 2: mod_base = cm
  modified_base 3: mod_base = cm
  modified_base 4: mod_base = um
  modified_base 5: mod_base = um
  modified_base 6: mod_base = cm
  modified_base 7: mod_base = cm
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-cytidine
  modified_base 11: mod_base = OTHER; note = 2'-fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = gm
  modified_base 15: mod_base = OTHER; note = 2'-O-methyl-adenosine
  modified_base 16: mod_base = um
  modified_base 17: mod_base = um
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1108 - RNA, 36 nt, synthetic construct; identical to SEQ ID NO: 928
  modified_base 1^2: mod_base = OTHER; note = linked via phosphorothioate
  modified_base 1: mod_base = OTHER; note = 2'-O-methyl-adenosine
  modified_base 2: mod_base = cm
  modified_base 3: mod_base = cm
  modified_base 4: mod_base = um
  modified_base 5: mod_base = gm
  modified_base 6: mod_base = gm
  modified_base 7: mod_base = um
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-adenosine
  modified_base 12: mod_base = OTHER; note = 2'-O-methyl-adenosine
  modified_base 13: mod_base = um
  modified_base 14: mod_base = um
  modified_base 15: mod_base = OTHER; note = 2'-O-methyl-adenosine
  modified_base 16: mod_base = um
  modified_base 17: mod_base = um
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1109 - RNA, 36 nt, synthetic construct; identical to SEQ ID NO: 929
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = gm
  modified_base 7: mod_base = um
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-cytidine
  modified_base 12: mod_base = um
  modified_base 13: mod_base = um
  modified_base 14: mod_base = um
  modified_base 15: mod_base = um
  modified_base 16: mod_base = um
  modified_base 17: mod_base = um
  modified_base 18: mod_base = OTHER; note = 2'-O-methyl-adenosine
  modified_base 19: mod_base = cm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1110 - RNA, 36 nt, synthetic construct; identical to SEQ ID NO: 930
  modified_base 1^2: mod_base = OTHER; note = linked via phosphorothioate
  modified_base 1: mod_base = cm
  modified_base 2: mod_base = OTHER; note = 2'-O-methyl-adenosine
  modified_base 3: mod_base = gm
  modified_base 4: mod_base = um
  modified_base 5: mod_base = um
  modified_base 6: mod_base = cm
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-uridine
  modified_base 10: mod_base = OTHER; note = 2'-fluoro-adenosine
  modified_base 11: mod_base = OTHER; note = 2'-fluoro-cytidine
  modified_base 12: mod_base = um
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = gm
  modified_base 17: mod_base = um
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1111 - RNA, 36 nt, synthetic construct; identical to SEQ ID NO: 931
  modified_base 1^2: mod_base = OTHER; note = linked via phosphorothioate
  modified_base 1: mod_base = cm
  modified_base 2: mod_base = OTHER; note = 2'-O-methyl-adenosine
  modified_base 3: mod_base = OTHER; note = 2'-O-methyl-adenosine
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = um
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-adenosine
  modified_base 11: mod_base = OTHER; note = 2'-fluoro-adenosine
  modified_base 12: mod_base = OTHER; note = 2'-O-methyl-adenosine
  modified_base 13: mod_base = cm
  modified_base 14: mod_base = um
  modified_base 15: mod_base = um
  modified_base 16: mod_base = um
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1112 - RNA, 36 nt, synthetic construct; identical to SEQ ID NO: 932
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = cm
  modified_base 5: mod_base = OTHER; note = 2'-O-methyl-adenosine
  modified_base 6: mod_base = OTHER; note = 2'-O-methyl-adenosine
  modified_base 7: mod_base = gm
  modified_base 8: mod_base = OTHER; note = 2'-fluoro-adenosine
  modified_base 9: mod_base = OTHER; note = 2'-fluoro-guanosine
  modified_base 10: mod_base = OTHER; note = 2'-fluoro-uridine
  modified_base 11: mod_base = OTHER; note = 2'-fluoro-cytidine
  modified_base 12: mod_base = gm
  modified_base 13: mod_base = OTHER; note = 2'-O-methyl-adenosine
  modified_base 14: mod_base = OTHER; note = 2'-O-methyl-adenosine
  modified_base 15: mod_base = um
  modified_base 16: mod_base = gm
  modified_base 17: mod_base = um
  modified_base 18: mod_base = um
  modified_base 19: mod_base = cm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1113 - RNA, 36 nt, synthetic construct; identical to SEQ ID NO: 933
  modified_base 1^2: mod_base = OTHER; note = linked via phosphorothioate
  modified_base 1: mod_base = gm
  modified_base 2: mod_base = gm
  modified_base 3: mod_base = um
  modified_base 4: mod_base = gm
  modified_base 5: mod_base = um
  modified_base 6: mod_base = gm
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-uridine
  modified_base 10: mod_base = OTHER; note = 2'-fluoro-uridine
  modified_base 11: mod_base = OTHER; note = 2'-fluoro-adenosine
  modified_base 12: mod_base = um
  modified_base 13: mod_base = um
  modified_base 14: mod_base = cm
  modified_base 15: mod_base = OTHER; note = 2'-O-methyl-adenosine
  modified_base 16: mod_base = gm
  modified_base 17: mod_base = gm
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1114 - RNA, 36 nt, synthetic construct; identical to SEQ ID NO: 934
  modified_base 1^2: mod_base = OTHER; note = linked via phosphorothioate
  modified_base 1: mod_base = cm
  modified_base 2: mod_base = cm
  modified_base 3: mod_base = OTHER; note = 2'-O-methyl-adenosine
  modified_base 4: mod_base = OTHER; note = 2'-O-methyl-adenosine
  modified_base 5: mod_base = gm
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-uridine
  modified_base 11: mod_base = OTHER; note = 2'-fluoro-adenosine
  modified_base 12: mod_base = OTHER; note = 2'-O-methyl-adenosine
  modified_base 13: mod_base = OTHER; note = 2'-O-methyl-adenosine
  modified_base 14: mod_base = cm
  modified_base 15: mod_base = um
  modified_base 16: mod_base = um
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1115 - RNA, 36 nt, synthetic construct; identical to SEQ ID NO: 935
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = cm
  modified_base 4: mod_base = OTHER; note = 2'-O-methyl-adenosine
  modified_base 5: mod_base = gm
  modified_base 6: mod_base = cm
  modified_base 7: mod_base = OTHER; note = 2'-O-methyl-adenosine
  modified_base 8: mod_base = OTHER; note = 2'-fluoro-guanosine
  modified_base 9: mod_base = OTHER; note = 2'-fluoro-cytidine
  modified_base 10: mod_base = OTHER; note = 2'-fluoro-uridine
  modified_base 11: mod_base = OTHER; note = 2'-fluoro-guanosine
  modified_base 12: mod_base = OTHER; note = 2'-O-methyl-adenosine
  modified_base 13: mod_base = OTHER; note = 2'-O-methyl-adenosine
  modified_base 14: mod_base = cm
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1116 - RNA, 36 nt, synthetic construct; identical to SEQ ID NO: 936
  modified_base 1^2: mod_base = OTHER; note = linked via phosphorothioate
  modified_base 1: mod_base = gm
  modified_base 2: mod_base = cm
  modified_base 3: mod_base = um
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = cm
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-cytidine
  modified_base 11: mod_base = OTHER; note = 2'-fluoro-adenosine
  modified_base 12: mod_base = um
  modified_base 13: mod_base = gm
  modified_base 14: mod_base = um
  modified_base 15: mod_base = cm
  modified_base 16: mod_base = OTHER; note = 2'-O-methyl-adenosine
  modified_base 17: mod_base = um
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1117 - RNA, 36 nt, synthetic construct; identical to SEQ ID NO: 937
  modified_base 1^2: mod_base = OTHER; note = linked via phosphorothioate
  modified_base 1: mod_base = cm
  modified_base 2: mod_base = um
  modified_base 3: mod_base = gm
  modified_base 4: mod_base = OTHER; note = 2'-O-methyl-adenosine
  modified_base 5: mod_base = OTHER; note = 2'-O-methyl-adenosine
  modified_base 6: mod_base = cm
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-cytidine
  modified_base 10: mod_base = OTHER; note = 2'-fluoro-adenosine
  modified_base 11: mod_base = OTHER; note = 2'-fluoro-uridine
  modified_base 12: mod_base = gm
  modified_base 13: mod_base = um
  modified_base 14: mod_base = cm
  modified_base 15: mod_base = OTHER; note = 2'-O-methyl-adenosine
  modified_base 16: mod_base = um
  modified_base 17: mod_base = um
  modified_base 18: mod_base = um
  modified_base 19: mod_base = gm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1118 - RNA, 36 nt, synthetic construct; identical to SEQ ID NO: 938
  modified_base 1^2: mod_base = OTHER; note = linked via phosphorothioate
  modified_base 1: mod_base = cm
  modified_base 2: mod_base = OTHER; note = 2'-O-methyl-adenosine
  modified_base 3: mod_base = gm
  modified_base 4: mod_base = cm
  modified_base 5: mod_base = OTHER; note = 2'-O-methyl-adenosine
  modified_base 6: mod_base = gm
  modified_base 7: mod_base = cm
  modified_base 8: mod_base = OTHER; note = 2'-fluoro-uridine
  modified_base 9: mod_base = OTHER; note = 2'-fluoro-guanosine
  modified_base 10: mod_base = OTHER; note = 2'-fluoro-adenosine
  modified_base 11: mod_base = OTHER; note = 2'-fluoro-adenosine
  modified_base 12: mod_base = cm
  modified_base 13: mod_base = OTHER; note = 2'-O-methyl-adenosine
  modified_base 14: mod_base = OTHER; note = 2'-O-methyl-adenosine
  modified_base 15: mod_base = cm
  modified_base 16: mod_base = OTHER; note = 2'-O-methyl-adenosine
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1119 - RNA, 36 nt, synthetic construct; identical to SEQ ID NO: 939
  modified_base 1^2: mod_base = OTHER; note = linked via phosphorothioate
  modified_base 1: mod_base = um
  modified_base 2: mod_base = um
  modified_base 3: mod_base = um
  modified_base 4: mod_base = OTHER; note = 2'-O-methyl-adenosine
  modified_base 5: mod_base = OTHER; note = 2'-O-methyl-adenosine
  modified_base 6: mod_base = cm
  modified_base 7: mod_base = um
  modified_base 8: mod_base = OTHER; note = 2'-fluoro-uridine
  modified_base 9: mod_base = OTHER; note = 2'-fluoro-cytidine
  modified_base 10: mod_base = OTHER; note = 2'-fluoro-cytidine
  modified_base 11: mod_base = OTHER; note = 2'-fluoro-adenosine
  modified_base 12: mod_base = gm
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1120 - RNA, 36 nt, synthetic construct; identical to SEQ ID NO: 940
  modified_base 1^2: mod_base = OTHER; note = linked via phosphorothioate
  modified_base 1: mod_base = OTHER; note = 2'-O-methyl-adenosine
  modified_base 2: mod_base = gm
  modified_base 3: mod_base = cm
  modified_base 4: mod_base = OTHER; note = 2'-O-methyl-adenosine
  modified_base 5: mod_base = gm
  modified_base 6: mod_base = cm
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-cytidine
  modified_base 12: mod_base = OTHER; note = 2'-O-methyl-adenosine
  modified_base 13: mod_base = OTHER; note = 2'-O-methyl-adenosine
  modified_base 14: mod_base = cm
  modified_base 15: mod_base = OTHER; note = 2'-O-methyl-adenosine
  modified_base 16: mod_base = um
  modified_base 17: mod_base = gm
  modified_base 18: mod_base = um
  modified_base 19: mod_base = cm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1121 - RNA, 36 nt, synthetic construct; identical to SEQ ID NO: 941
  modified_base 1^2: mod_base = OTHER; note = linked via phosphorothioate
  modified_base 1: mod_base = um
  modified_base 2: mod_base = um
  modified_base 3: mod_base = gm
  modified_base 4: mod_base = OTHER; note = 2'-O-methyl-adenosine
  modified_base 5: mod_base = um
  modified_base 6: mod_base = gm
  modified_base 7: mod_base = cm
  modified_base 8: mod_base = OTHER; note = 2'-fluoro-adenosine
  modified_base 9: mod_base = OTHER; note = 2'-fluoro-guanosine
  modified_base 10: mod_base = OTHER; note = 2'-fluoro-uridine
  modified_base 11: mod_base = OTHER; note = 2'-fluoro-uridine
  modified_base 12: mod_base = um
  modified_base 13: mod_base = gm
  modified_base 14: mod_base = gm
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1122 - RNA, 36 nt, synthetic construct; identical to SEQ ID NO: 942
  modified_base 1^2: mod_base = OTHER; note = linked via phosphorothioate
  modified_base 1: mod_base = um
  modified_base 2: mod_base = gm
  modified_base 3: mod_base = OTHER; note = 2'-O-methyl-adenosine
  modified_base 4: mod_base = OTHER; note = 2'-O-methyl-adenosine
  modified_base 5: mod_base = cm
  modified_base 6: mod_base = OTHER; note = 2'-O-methyl-adenosine
  modified_base 7: mod_base = OTHER; note = 2'-O-methyl-adenosine
  modified_base 8: mod_base = OTHER; note = 2'-fluoro-cytidine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-guanosine
  modified_base 12: mod_base = um
  modified_base 13: mod_base = cm
  modified_base 14: mod_base = OTHER; note = 2'-O-methyl-adenosine
  modified_base 15: mod_base = um
  modified_base 16: mod_base = um
  modified_base 17: mod_base = um
  modified_base 18: mod_base = gm
  modified_base 19: mod_base = cm
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1123 - RNA, 36 nt, synthetic construct; identical to SEQ ID NO: 943
  modified_base 1^2: mod_base = OTHER; note = linked via phosphorothioate
  modified_base 1: mod_base = um
  modified_base 2: mod_base = OTHER; note = 2'-O-methyl-adenosine
  modified_base 3: mod_base = gm
  modified_base 4: mod_base = um
  modified_base 5: mod_base = gm
  modified_base 6: mod_base = um
  modified_base 7: mod_base = OTHER; note = 2'-O-methyl-adenosine
  modified_base 8: mod_base = OTHER; note = 2'-fluoro-adenosine
  modified_base 9: mod_base = OTHER; note = 2'-fluoro-adenosine
  modified_base 10: mod_base = OTHER; note = 2'-fluoro-adenosine
  modified_base 11: mod_base = OTHER; note = 2'-fluoro-adenosine
  modified_base 12: mod_base = um
  modified_base 13: mod_base = um
  modified_base 14: mod_base = um
  modified_base 15: mod_base = OTHER; note = 2'-O-methyl-adenosine
  modified_base 16: mod_base = um
  modified_base 17: mod_base = OTHER; note = 2'-O-methyl-adenosine
  modified_base 18: mod_base = um
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1124 - RNA, 36 nt, synthetic construct; identical to SEQ ID NO: 944
  modified_base 1^2: mod_base = OTHER; note = linked via phosphorothioate
  modified_base 1: mod_base = um
  modified_base 2: mod_base = OTHER; note = 2'-O-methyl-adenosine
  modified_base 3: mod_base = OTHER; note = 2'-O-methyl-adenosine
  modified_base 4: mod_base = cm
  modified_base 5: mod_base = um
  modified_base 6: mod_base = um
  modified_base 7: mod_base = um
  modified_base 8: mod_base = OTHER; note = 2'-fluoro-guanosine
  modified_base 9: mod_base = OTHER; note = 2'-fluoro-uridine
  modified_base 10: mod_base = OTHER; note = 2'-fluoro-guanosine
  modified_base 11: mod_base = OTHER; note = 2'-fluoro-guanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyl-adenosine
  modified_base 17: mod_base = gm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1125 - RNA, 36 nt, synthetic construct; identical to SEQ ID NO: 945
  modified_base 1^2: mod_base = OTHER; note = linked via phosphorothioate
  modified_base 1: mod_base = OTHER; note = 2'-O-methyl-adenosine
  modified_base 2: mod_base = OTHER; note = 2'-O-methyl-adenosine
  modified_base 3: mod_base = gm
  modified_base 4: mod_base = cm
  modified_base 5: mod_base = OTHER; note = 2'-O-methyl-adenosine
  modified_base 6: mod_base = gm
  modified_base 7: mod_base = cm
  modified_base 8: mod_base = OTHER; note = 2'-fluoro-adenosine
  modified_base 9: mod_base = OTHER; note = 2'-fluoro-guanosine
  modified_base 10: mod_base = OTHER; note = 2'-fluoro-cytidine
  modified_base 11: mod_base = OTHER; note = 2'-fluoro-uridine
  modified_base 12: mod_base = gm
  modified_base 13: mod_base = OTHER; note = 2'-O-methyl-adenosine
  modified_base 14: mod_base = OTHER; note = 2'-O-methyl-adenosine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1126 - RNA, 36 nt, synthetic construct; identical to SEQ ID NO: 946
  modified_base 1^2: mod_base = OTHER; note = linked via phosphorothioate
  modified_base 1: mod_base = cm
  modified_base 2: mod_base = OTHER; note = 2'-O-methyl-adenosine
  modified_base 3: mod_base = OTHER; note = 2'-O-methyl-adenosine
  modified_base 4: mod_base = OTHER; note = 2'-O-methyl-adenosine
  modified_base 5: mod_base = OTHER; note = 2'-O-methyl-adenosine
  modified_base 6: mod_base = gm
  modified_base 7: mod_base = um
  modified_base 8: mod_base = OTHER; note = 2'-fluoro-guanosine
  modified_base 9: mod_base = OTHER; note = 2'-fluoro-adenosine
  modified_base 10: mod_base = OTHER; note = 2'-fluoro-uridine
  modified_base 11: mod_base = OTHER; note = 2'-fluoro-guanosine
  modified_base 12: mod_base = OTHER; note = 2'-O-methyl-adenosine
  modified_base 13: mod_base = OTHER; note = 2'-O-methyl-adenosine
  modified_base 14: mod_base = cm
  modified_base 15: mod_base = OTHER; note = 2'-O-methyl-adenosine
  modified_base 16: mod_base = um
  modified_base 17: mod_base = gm
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 22: mod_base = cm
  modified_base 23: mod_base = OTHER; note = 2'-O-methyl-adenosine
  modified_base 24: mod_base = gm
  modified_base 25: mod_base = cm
  modified_base 26: mod_base = cm
  modified_base 27: mod_base = gm
  modified_base 28: mod_base = OTHER; note = aminodiethoxymethanol-adenine-N-acetylgalactosamine
  modified_base 29: mod_base = OTHER; note = aminodiethoxymethanol-adenine-N-acetylgalactosamine
  modified_base 30: mod_base = OTHER; note = aminodiethoxymethanol-adenine-N-acetylgalactosamine
  modified_base 31: mod_base = gm
  modified_base 32: mod_base = gm
  modified_base 33: mod_base = cm
  modified_base 34: mod_base = um
  modified_base 35: mod_base = gm
  modified_base 36: mod_base = cm
  source 1..36: mol_type = other RNA

SEQ ID NO: 1127 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-guanosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-cytidine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-adenosine
  modified_base 11: mod_base = gm
  modified_base 12: mod_base = um
  modified_base 13: mod_base = cm
  modified_base 14: mod_base = OTHER; note = 2'-fluoro-adenosine
  modified_base 15: mod_base = um
  modified_base 16: mod_base = cm
  modified_base 17: mod_base = cm
  modified_base 18: mod_base = um
  modified_base 19: mod_base = gm
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tgaaatcaaagtcatcctgggg

SEQ ID NO: 1128 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-uridine
  modified_base 8: mod_base = cm
  modified_base 9: mod_base = OTHER; note = 2'-O-methyl-adenosine
  modified_base 10: mod_base = OTHER; note = 2'-fluoro-adenosine
  modified_base 11: mod_base = OTHER; note = 2'-O-methyl-adenosine
  modified_base 12: mod_base = gm
  modified_base 13: mod_base = um
  modified_base 14: mod_base = OTHER; note = 2'-fluoro-cytidine
  modified_base 15: mod_base = OTHER; note = 2'-O-methyl-adenosine
  modified_base 16: mod_base = um
  modified_base 17: mod_base = cm
  modified_base 18: mod_base = cm
  modified_base 19: mod_base = um
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
ttgaaatcaaagtcatcctggg

SEQ ID NO: 1129 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-guanosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-adenosine
  modified_base 8: mod_base = um
  modified_base 9: mod_base = cm
  modified_base 10: mod_base = OTHER; note = 2'-fluoro-adenosine
  modified_base 11: mod_base = OTHER; note = 2'-O-methyl-adenosine
  modified_base 12: mod_base = OTHER; note = 2'-O-methyl-adenosine
  modified_base 13: mod_base = gm
  modified_base 14: mod_base = OTHER; note = 2'-fluoro-uridine
  modified_base 15: mod_base = cm
  modified_base 16: mod_base = OTHER; note = 2'-O-methyl-adenosine
  modified_base 17: mod_base = um
  modified_base 18: mod_base = cm
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttgaaatcaaagtcatcctgg

SEQ ID NO: 1130 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-guanosine
  modified_base 5: mod_base = OTHER; note = 2'-fluoro-uridine
  modified_base 6: mod_base = um
  modified_base 7: mod_base = OTHER; note = 2'-fluoro-guanosine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-adenosine
  modified_base 11: mod_base = um
  modified_base 12: mod_base = cm
  modified_base 13: mod_base = OTHER; note = 2'-O-methyl-adenosine
  modified_base 14: mod_base = OTHER; note = 2'-fluoro-adenosine
  modified_base 15: mod_base = OTHER; note = 2'-O-methyl-adenosine
  modified_base 16: mod_base = gm
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttagttgaaatcaaagtcatgg

SEQ ID NO: 1131 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-uridine
  modified_base 6: mod_base = um
  modified_base 7: mod_base = OTHER; note = 2'-fluoro-adenosine
  modified_base 8: mod_base = um
  modified_base 9: mod_base = gm
  modified_base 10: mod_base = OTHER; note = 2'-fluoro-adenosine
  modified_base 11: mod_base = OTHER; note = 2'-O-methyl-adenosine
  modified_base 12: mod_base = OTHER; note = 2'-O-methyl-adenosine
  modified_base 13: mod_base = cm
  modified_base 14: mod_base = OTHER; note = 2'-fluoro-adenosine
  modified_base 15: mod_base = cm
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tagattatgaaacaccaaaggg

SEQ ID NO: 1132 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-guanosine
  modified_base 6: mod_base = um
  modified_base 7: mod_base = OTHER; note = 2'-fluoro-uridine
  modified_base 8: mod_base = gm
  modified_base 9: mod_base = OTHER; note = 2'-O-methyl-adenosine
  modified_base 10: mod_base = OTHER; note = 2'-fluoro-adenosine
  modified_base 11: mod_base = OTHER; note = 2'-O-methyl-adenosine
  modified_base 12: mod_base = um
  modified_base 13: mod_base = cm
  modified_base 14: mod_base = OTHER; note = 2'-fluoro-adenosine
  modified_base 15: mod_base = OTHER; note = 2'-O-methyl-adenosine
  modified_base 16: mod_base = OTHER; note = 2'-O-methyl-adenosine
  modified_base 17: mod_base = gm
  modified_base 18: mod_base = um
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tatagttgaaatcaaagtcagg

SEQ ID NO: 1133 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-uridine
  modified_base 5: mod_base = OTHER; note = 2'-fluoro-adenosine
  modified_base 6: mod_base = gm
  modified_base 7: mod_base = OTHER; note = 2'-fluoro-uridine
  modified_base 8: mod_base = um
  modified_base 9: mod_base = gm
  modified_base 10: mod_base = OTHER; note = 2'-fluoro-adenosine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-fluoro-cytidine
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = um
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
ttatagttgaaatcaaagtcgg

SEQ ID NO: 1134 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-guanosine
  modified_base 5: mod_base = OTHER; note = 2'-fluoro-uridine
  modified_base 6: mod_base = um
  modified_base 7: mod_base = OTHER; note = 2'-fluoro-uridine
  modified_base 8: mod_base = cm
  modified_base 9: mod_base = cm
  modified_base 10: mod_base = OTHER; note = 2'-fluoro-adenosine
  modified_base 11: mod_base = um
  modified_base 12: mod_base = um
  modified_base 13: mod_base = cm
  modified_base 14: mod_base = OTHER; note = 2'-fluoro-adenosine
  modified_base 15: mod_base = gm
  modified_base 16: mod_base = OTHER; note = 2'-O-methyl-adenosine
  modified_base 17: mod_base = um
  modified_base 18: mod_base = cm
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttgtttccattcagatcttgg

SEQ ID NO: 1135 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-guanosine
  modified_base 5: mod_base = OTHER; note = 2'-fluoro-adenosine
  modified_base 6: mod_base = cm
  modified_base 7: mod_base = OTHER; note = 2'-fluoro-guanosine
  modified_base 8: mod_base = um
  modified_base 9: mod_base = um
  modified_base 10: mod_base = OTHER; note = 2'-fluoro-adenosine
  modified_base 11: mod_base = um
  modified_base 12: mod_base = cm
  modified_base 13: mod_base = cm
  modified_base 14: mod_base = OTHER; note = 2'-fluoro-adenosine
  modified_base 15: mod_base = gm
  modified_base 16: mod_base = um
  modified_base 17: mod_base = um
  modified_base 18: mod_base = um
  modified_base 19: mod_base = um
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
tatgacgttatccagttttcgg

SEQ ID NO: 1136 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-cytidine
  modified_base 5: mod_base = OTHER; note = 2'-fluoro-uridine
  modified_base 6: mod_base = OTHER; note = 2'-O-methyl-adenosine
  modified_base 7: mod_base = OTHER; note = 2'-fluoro-adenosine
  modified_base 8: mod_base = um
  modified_base 9: mod_base = gm
  modified_base 10: mod_base = OTHER; note = 2'-fluoro-adenosine
  modified_base 11: mod_base = cm
  modified_base 12: mod_base = gm
  modified_base 13: mod_base = um
  modified_base 14: mod_base = OTHER; note = 2'-fluoro-uridine
  modified_base 15: mod_base = OTHER; note = 2'-O-methyl-adenosine
  modified_base 16: mod_base = um
  modified_base 17: mod_base = cm
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
ttgctaatgacgttatccaggg

SEQ ID NO: 1137 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-uridine
  modified_base 6: mod_base = um
  modified_base 7: mod_base = OTHER; note = 2'-fluoro-adenosine
  modified_base 8: mod_base = OTHER; note = 2'-O-methyl-adenosine
  modified_base 9: mod_base = gm
  modified_base 10: mod_base = OTHER; note = 2'-fluoro-uridine
  modified_base 11: mod_base = um
  modified_base 12: mod_base = um
  modified_base 13: mod_base = cm
  modified_base 14: mod_base = OTHER; note = 2'-fluoro-uridine
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
ttcattaagtttctaaacaggg

SEQ ID NO: 1138 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-adenosine
  modified_base 4: mod_base = OTHER; note = 2'-fluoro-cytidine
  modified_base 5: mod_base = OTHER; note = 2'-fluoro-uridine
  modified_base 6: mod_base = um
  modified_base 7: mod_base = OTHER; note = 2'-fluoro-uridine
  modified_base 8: mod_base = um
  modified_base 9: mod_base = cm
  modified_base 10: mod_base = OTHER; note = 2'-fluoro-adenosine
  modified_base 11: mod_base = um
  modified_base 12: mod_base = um
  modified_base 13: mod_base = OTHER; note = 2'-O-methyl-adenosine
  modified_base 14: mod_base = OTHER; note = 2'-fluoro-adenosine
  modified_base 15: mod_base = gm
  modified_base 16: mod_base = um
  modified_base 17: mod_base = um
  modified_base 18: mod_base = um
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tcacttttcattaagtttctgg

SEQ ID NO: 1139 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-adenosine
  modified_base 6: mod_base = cm
  modified_base 7: mod_base = OTHER; note = 2'-fluoro-uridine
  modified_base 8: mod_base = cm
  modified_base 9: mod_base = OTHER; note = 2'-O-methyl-adenosine
  modified_base 10: mod_base = OTHER; note = 2'-fluoro-guanosine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-fluoro-adenosine
  modified_base 15: mod_base = um
  modified_base 16: mod_base = um
  modified_base 17: mod_base = um
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
ttcaactcagggaatttgacgg

SEQ ID NO: 1140 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = cm
  modified_base 9: mod_base = OTHER; note = 2'-O-methyl-adenosine
  modified_base 10: mod_base = OTHER; note = 2'-fluoro-adenosine
  modified_base 11: mod_base = cm
  modified_base 12: mod_base = um
  modified_base 13: mod_base = cm
  modified_base 14: mod_base = OTHER; note = 2'-fluoro-adenosine
  modified_base 15: mod_base = gm
  modified_base 16: mod_base = gm
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tataattcaactcagggaatgg

SEQ ID NO: 1141 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-guanosine
  modified_base 5: mod_base = OTHER; note = 2'-fluoro-cytidine
  modified_base 6: mod_base = um
  modified_base 7: mod_base = OTHER; note = 2'-fluoro-guanosine
  modified_base 8: mod_base = OTHER; note = 2'-O-methyl-adenosine
  modified_base 9: mod_base = um
  modified_base 10: mod_base = OTHER; note = 2'-fluoro-adenosine
  modified_base 11: mod_base = OTHER; note = 2'-O-methyl-adenosine
  modified_base 12: mod_base = um
  modified_base 13: mod_base = um
  modified_base 14: mod_base = OTHER; note = 2'-fluoro-cytidine
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = um
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
taagctgataattcaactcagg

SEQ ID NO: 1142 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-guanosine
  modified_base 6: mod_base = cm
  modified_base 7: mod_base = OTHER; note = 2'-fluoro-uridine
  modified_base 8: mod_base = gm
  modified_base 9: mod_base = OTHER; note = 2'-O-methyl-adenosine
  modified_base 10: mod_base = OTHER; note = 2'-fluoro-uridine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-fluoro-uridine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = um
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
ttaagctgataattcaactcgg

SEQ ID NO: 1143 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = gm
  modified_base 7: mod_base = OTHER; note = 2'-fluoro-cytidine
  modified_base 8: mod_base = um
  modified_base 9: mod_base = gm
  modified_base 10: mod_base = OTHER; note = 2'-fluoro-adenosine
  modified_base 11: mod_base = um
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-uridine
  modified_base 15: mod_base = um
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttaagctgataattcaactgg

SEQ ID NO: 1144 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-uridine
  modified_base 6: mod_base = um
  modified_base 7: mod_base = OTHER; note = 2'-fluoro-adenosine
  modified_base 8: mod_base = OTHER; note = 2'-O-methyl-adenosine
  modified_base 9: mod_base = gm
  modified_base 10: mod_base = OTHER; note = 2'-fluoro-cytidine
  modified_base 11: mod_base = um
  modified_base 12: mod_base = gm
  modified_base 13: mod_base = OTHER; note = 2'-O-methyl-adenosine
  modified_base 14: mod_base = OTHER; note = 2'-fluoro-uridine
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = um
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tattttaagctgataattcagg

SEQ ID NO: 1145 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-uridine
  modified_base 6: mod_base = um
  modified_base 7: mod_base = OTHER; note = 2'-fluoro-uridine
  modified_base 8: mod_base = um
  modified_base 9: mod_base = OTHER; note = 2'-O-methyl-adenosine
  modified_base 10: mod_base = OTHER; note = 2'-fluoro-adenosine
  modified_base 11: mod_base = gm
  modified_base 12: mod_base = cm
  modified_base 13: mod_base = um
  modified_base 14: mod_base = OTHER; note = 2'-fluoro-guanosine
  modified_base 15: mod_base = OTHER; note = 2'-O-methyl-adenosine
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttaattttaagctgataattgg

SEQ ID NO: 1146 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = um
  modified_base 9: mod_base = um
  modified_base 10: mod_base = OTHER; note = 2'-fluoro-adenosine
  modified_base 11: mod_base = OTHER; note = 2'-O-methyl-adenosine
  modified_base 12: mod_base = gm
  modified_base 13: mod_base = cm
  modified_base 14: mod_base = OTHER; note = 2'-fluoro-uridine
  modified_base 15: mod_base = gm
  modified_base 16: mod_base = OTHER; note = 2'-O-methyl-adenosine
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttaattttaagctgataatgg

SEQ ID NO: 1147 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-cytidine
  modified_base 6: mod_base = um
  modified_base 7: mod_base = OTHER; note = 2'-fluoro-uridine
  modified_base 8: mod_base = um
  modified_base 9: mod_base = OTHER; note = 2'-O-methyl-adenosine
  modified_base 10: mod_base = OTHER; note = 2'-fluoro-adenosine
  modified_base 11: mod_base = um
  modified_base 12: mod_base = um
  modified_base 13: mod_base = um
  modified_base 14: mod_base = OTHER; note = 2'-fluoro-uridine
  modified_base 15: mod_base = OTHER; note = 2'-O-methyl-adenosine
  modified_base 16: mod_base = OTHER; note = 2'-O-methyl-adenosine
  modified_base 17: mod_base = gm
  modified_base 18: mod_base = cm
  modified_base 19: mod_base = um
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tacactttaattttaagctggg

SEQ ID NO: 1148 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-adenosine
  modified_base 4: mod_base = OTHER; note = 2'-fluoro-cytidine
  modified_base 5: mod_base = OTHER; note = 2'-fluoro-adenosine
  modified_base 6: mod_base = cm
  modified_base 7: mod_base = OTHER; note = 2'-fluoro-uridine
  modified_base 8: mod_base = um
  modified_base 9: mod_base = um
  modified_base 10: mod_base = OTHER; note = 2'-fluoro-adenosine
  modified_base 11: mod_base = OTHER; note = 2'-O-methyl-adenosine
  modified_base 12: mod_base = um
  modified_base 13: mod_base = um
  modified_base 14: mod_base = OTHER; note = 2'-fluoro-uridine
  modified_base 15: mod_base = um
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tcacactttaattttaagctgg

SEQ ID NO: 1149 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-cytidine
  modified_base 6: mod_base = cm
  modified_base 7: mod_base = OTHER; note = 2'-fluoro-cytidine
  modified_base 8: mod_base = um
  modified_base 9: mod_base = gm
  modified_base 10: mod_base = OTHER; note = 2'-fluoro-adenosine
  modified_base 11: mod_base = OTHER; note = 2'-O-methyl-adenosine
  modified_base 12: mod_base = um
  modified_base 13: mod_base = OTHER; note = 2'-O-methyl-adenosine
  modified_base 14: mod_base = OTHER; note = 2'-fluoro-adenosine
  modified_base 15: mod_base = um
  modified_base 16: mod_base = um
  modified_base 17: mod_base = cm
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tacaccctgaataattcacagg

SEQ ID NO: 1150 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-adenosine
  modified_base 6: mod_base = gm
  modified_base 7: mod_base = OTHER; note = 2'-fluoro-guanosine
  modified_base 8: mod_base = um
  modified_base 9: mod_base = cm
  modified_base 10: mod_base = OTHER; note = 2'-fluoro-adenosine
  modified_base 11: mod_base = OTHER; note = 2'-O-methyl-adenosine
  modified_base 12: mod_base = um
  modified_base 13: mod_base = gm
  modified_base 14: mod_base = OTHER; note = 2'-fluoro-adenosine
  modified_base 15: mod_base = um
  modified_base 16: mod_base = OTHER; note = 2'-O-methyl-adenosine
  modified_base 17: mod_base = um
  modified_base 18: mod_base = um
  modified_base 19: mod_base = gm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tacaaggtcaatgatattgtgg

SEQ ID NO: 1151 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-cytidine
  modified_base 6: mod_base = OTHER; note = 2'-O-methyl-adenosine
  modified_base 7: mod_base = OTHER; note = 2'-fluoro-adenosine
  modified_base 8: mod_base = gm
  modified_base 9: mod_base = gm
  modified_base 10: mod_base = OTHER; note = 2'-fluoro-uridine
  modified_base 11: mod_base = cm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-uridine
  modified_base 15: mod_base = gm
  modified_base 16: mod_base = OTHER; note = 2'-O-methyl-adenosine
  modified_base 17: mod_base = um
  modified_base 18: mod_base = OTHER; note = 2'-O-methyl-adenosine
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttcacaaggtcaatgatattgg

SEQ ID NO: 1152 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-uridine
  modified_base 6: mod_base = cm
  modified_base 7: mod_base = OTHER; note = 2'-fluoro-adenosine
  modified_base 8: mod_base = cm
  modified_base 9: mod_base = OTHER; note = 2'-O-methyl-adenosine
  modified_base 10: mod_base = OTHER; note = 2'-fluoro-adenosine
  modified_base 11: mod_base = gm
  modified_base 12: mod_base = gm
  modified_base 13: mod_base = um
  modified_base 14: mod_base = OTHER; note = 2'-fluoro-cytidine
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttttcacaaggtcaatgatgg

SEQ ID NO: 1153 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-guanosine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = um
  modified_base 9: mod_base = cm
  modified_base 10: mod_base = OTHER; note = 2'-fluoro-adenosine
  modified_base 11: mod_base = gm
  modified_base 12: mod_base = cm
  modified_base 13: mod_base = OTHER; note = 2'-O-methyl-adenosine
  modified_base 14: mod_base = OTHER; note = 2'-fluoro-adenosine
  modified_base 15: mod_base = OTHER; note = 2'-O-methyl-adenosine
  modified_base 16: mod_base = um
  modified_base 17: mod_base = gm
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tatgatttcagcaaatgacagg

SEQ ID NO: 1154 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-uridine
  modified_base 6: mod_base = OTHER; note = 2'-O-methyl-adenosine
  modified_base 7: mod_base = OTHER; note = 2'-fluoro-adenosine
  modified_base 8: mod_base = OTHER; note = 2'-O-methyl-adenosine
  modified_base 9: mod_base = cm
  modified_base 10: mod_base = OTHER; note = 2'-fluoro-uridine
  modified_base 11: mod_base = um
  modified_base 12: mod_base = gm
  modified_base 13: mod_base = gm
  modified_base 14: mod_base = OTHER; note = 2'-fluoro-uridine
  modified_base 15: mod_base = cm
  modified_base 16: mod_base = um
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tagataaacttggtcttcaggg

SEQ ID NO: 1155 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-uridine
  modified_base 5: mod_base = OTHER; note = 2'-fluoro-cytidine
  modified_base 6: mod_base = OTHER; note = 2'-O-methyl-adenosine
  modified_base 7: mod_base = OTHER; note = 2'-fluoro-cytidine
  modified_base 8: mod_base = OTHER; note = 2'-O-methyl-adenosine
  modified_base 9: mod_base = cm
  modified_base 10: mod_base = OTHER; note = 2'-fluoro-adenosine
  modified_base 11: mod_base = gm
  modified_base 12: mod_base = OTHER; note = 2'-O-methyl-adenosine
  modified_base 13: mod_base = um
  modified_base 14: mod_base = OTHER; note = 2'-fluoro-adenosine
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = um
  modified_base 19: mod_base = um
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
ttgtcacacagataaacttggg

SEQ ID NO: 1156 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-cytidine
  modified_base 6: mod_base = cm
  modified_base 7: mod_base = OTHER; note = 2'-fluoro-adenosine
  modified_base 8: mod_base = um
  modified_base 9: mod_base = um
  modified_base 10: mod_base = OTHER; note = 2'-fluoro-adenosine
  modified_base 11: mod_base = um
  modified_base 12: mod_base = um
  modified_base 13: mod_base = um
  modified_base 14: mod_base = OTHER; note = 2'-fluoro-cytidine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttcaccattatttccaaactgg

SEQ ID NO: 1157 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-cytidine
  modified_base 5: mod_base = OTHER; note = 2'-fluoro-adenosine
  modified_base 6: mod_base = cm
  modified_base 7: mod_base = OTHER; note = 2'-fluoro-uridine
  modified_base 8: mod_base = cm
  modified_base 9: mod_base = OTHER; note = 2'-O-methyl-adenosine
  modified_base 10: mod_base = OTHER; note = 2'-fluoro-uridine
  modified_base 11: mod_base = um
  modified_base 12: mod_base = um
  modified_base 13: mod_base = cm
  modified_base 14: mod_base = OTHER; note = 2'-fluoro-uridine
  modified_base 15: mod_base = cm
  modified_base 16: mod_base = um
  modified_base 17: mod_base = OTHER; note = 2'-O-methyl-adenosine
  modified_base 18: mod_base = um
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttcactcatttctctatttgg

SEQ ID NO: 1158 - RNA, 22 nt, synthetic construct
  modified_base 1..4: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-cytidine
  modified_base 6: mod_base = OTHER; note = 2'-O-methyl-adenosine
  modified_base 7: mod_base = OTHER; note = 2'-fluoro-cytidine
  modified_base 8: mod_base = um
  modified_base 9: mod_base = cm
  modified_base 10: mod_base = OTHER; note = 2'-fluoro-adenosine
  modified_base 11: mod_base = um
  modified_base 12: mod_base = um
  modified_base 13: mod_base = um
  modified_base 14: mod_base = OTHER; note = 2'-fluoro-cytidine
  modified_base 15: mod_base = um
  modified_base 16: mod_base = cm
  modified_base 17: mod_base = um
  modified_base 18: mod_base = OTHER; note = 2'-O-methyl-adenosine
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tattcactcatttctctattgg

SEQ ID NO: 1159 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-adenosine
  modified_base 8: mod_base = um
  modified_base 9: mod_base = cm
  modified_base 10: mod_base = OTHER; note = 2'-fluoro-uridine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-fluoro-adenosine
  modified_base 15: mod_base = cm
  modified_base 16: mod_base = cm
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
taaaaaatctggaaccacaagg

SEQ ID NO: 1160 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-uridine
  modified_base 8: mod_base = cm
  modified_base 9: mod_base = um
  modified_base 10: mod_base = OTHER; note = 2'-fluoro-guanosine
  modified_base 11: mod_base = gm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-cytidine
  modified_base 15: mod_base = cm
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
taaaaatctggaaccacaaagg

SEQ ID NO: 1161 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-cytidine
  modified_base 4: mod_base = OTHER; note = 2'-fluoro-cytidine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-adenosine
  modified_base 8: mod_base = cm
  modified_base 9: mod_base = um
  modified_base 10: mod_base = OTHER; note = 2'-fluoro-guanosine
  modified_base 11: mod_base = cm
  modified_base 12: mod_base = OTHER; note = 2'-O-methyl-adenosine
  modified_base 13: mod_base = um
  modified_base 14: mod_base = OTHER; note = 2'-fluoro-cytidine
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
ttccaaactgcatcaatgaagg

SEQ ID NO: 1162 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-uridine
  modified_base 6: mod_base = um
  modified_base 7: mod_base = OTHER; note = 2'-fluoro-uridine
  modified_base 8: mod_base = cm
  modified_base 9: mod_base = cm
  modified_base 10: mod_base = OTHER; note = 2'-fluoro-adenosine
  modified_base 11: mod_base = OTHER; note = 2'-O-methyl-adenosine
  modified_base 12: mod_base = OTHER; note = 2'-O-methyl-adenosine
  modified_base 13: mod_base = cm
  modified_base 14: mod_base = OTHER; note = 2'-fluoro-uridine
  modified_base 15: mod_base = gm
  modified_base 16: mod_base = cm
  modified_base 17: mod_base = OTHER; note = 2'-O-methyl-adenosine
  modified_base 18: mod_base = um
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tttatttccaaactgcatcagg

SEQ ID NO: 1163 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-uridine
  modified_base 6: mod_base = cm
  modified_base 7: mod_base = OTHER; note = 2'-fluoro-adenosine
  modified_base 8: mod_base = gm
  modified_base 9: mod_base = cm
  modified_base 10: mod_base = OTHER; note = 2'-fluoro-adenosine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-fluoro-guanosine
  modified_base 15: mod_base = OTHER; note = 2'-O-methyl-adenosine
  modified_base 16: mod_base = cm
  modified_base 17: mod_base = OTHER; note = 2'-O-methyl-adenosine
  modified_base 18: mod_base = um
  modified_base 19: mod_base = gm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tatttcagcaaatgacatgtgg

SEQ ID NO: 1164 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-cytidine
  modified_base 8: mod_base = um
  modified_base 9: mod_base = gm
  modified_base 10: mod_base = OTHER; note = 2'-fluoro-guanosine
  modified_base 11: mod_base = OTHER; note = 2'-O-methyl-adenosine
  modified_base 12: mod_base = OTHER; note = 2'-O-methyl-adenosine
  modified_base 13: mod_base = cm
  modified_base 14: mod_base = OTHER; note = 2'-fluoro-cytidine
  modified_base 15: mod_base = OTHER; note = 2'-O-methyl-adenosine
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
taaaatctggaaccacaaaggg

SEQ ID NO: 1165 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-adenosine
  modified_base 8: mod_base = OTHER; note = 2'-O-methyl-adenosine
  modified_base 9: mod_base = um
  modified_base 10: mod_base = OTHER; note = 2'-fluoro-adenosine
  modified_base 11: mod_base = um
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-adenosine
  modified_base 15: mod_base = um
  modified_base 16: mod_base = um
  modified_base 17: mod_base = um
  modified_base 18: mod_base = um
  modified_base 19: mod_base = um
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tacaataatataaatttttagg

SEQ ID NO: 1166 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-cytidine
  modified_base 5: mod_base = OTHER; note = 2'-fluoro-cytidine
  modified_base 6: mod_base = OTHER; note = 2'-O-methyl-adenosine
  modified_base 7: mod_base = OTHER; note = 2'-fluoro-adenosine
  modified_base 8: mod_base = OTHER; note = 2'-O-methyl-adenosine
  modified_base 9: mod_base = cm
  modified_base 10: mod_base = OTHER; note = 2'-fluoro-uridine
  modified_base 11: mod_base = gm
  modified_base 12: mod_base = cm
  modified_base 13: mod_base = OTHER; note = 2'-O-methyl-adenosine
  modified_base 14: mod_base = OTHER; note = 2'-fluoro-uridine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = um
  modified_base 19: mod_base = gm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tttccaaactgcatcaatgagg

SEQ ID NO: 1167 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-uridine
  modified_base 6: mod_base = gm
  modified_base 7: mod_base = OTHER; note = 2'-fluoro-adenosine
  modified_base 8: mod_base = um
  modified_base 9: mod_base = gm
  modified_base 10: mod_base = OTHER; note = 2'-fluoro-adenosine
  modified_base 11: mod_base = um
  modified_base 12: mod_base = um
  modified_base 13: mod_base = um
  modified_base 14: mod_base = OTHER; note = 2'-fluoro-cytidine
  modified_base 15: mod_base = OTHER; note = 2'-O-methyl-adenosine
  modified_base 16: mod_base = gm
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tccatgatgatttcagcaaagg

SEQ ID NO: 1168 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-guanosine
  modified_base 4: mod_base = OTHER; note = 2'-fluoro-cytidine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-adenosine
  modified_base 8: mod_base = um
  modified_base 9: mod_base = gm
  modified_base 10: mod_base = OTHER; note = 2'-fluoro-adenosine
  modified_base 11: mod_base = cm
  modified_base 12: mod_base = OTHER; note = 2'-O-methyl-adenosine
  modified_base 13: mod_base = um
  modified_base 14: mod_base = OTHER; note = 2'-fluoro-guanosine
  modified_base 15: mod_base = um
  modified_base 16: mod_base = um
  modified_base 17: mod_base = gm
  modified_base 18: mod_base = um
  modified_base 19: mod_base = um
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
tagcaaatgacatgttgttcgg

SEQ ID NO: 1169 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-guanosine
  modified_base 6: mod_base = cm
  modified_base 7: mod_base = OTHER; note = 2'-fluoro-adenosine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-uridine
  modified_base 11: mod_base = gm
  modified_base 12: mod_base = OTHER; note = 2'-O-methyl-adenosine
  modified_base 13: mod_base = cm
  modified_base 14: mod_base = OTHER; note = 2'-fluoro-adenosine
  modified_base 15: mod_base = um
  modified_base 16: mod_base = gm
  modified_base 17: mod_base = um
  modified_base 18: mod_base = um
  modified_base 19: mod_base = gm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttcagcaaatgacatgttgtgg

SEQ ID NO: 1170 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-adenosine
  modified_base 4: mod_base = OTHER; note = 2'-fluoro-guanosine
  modified_base 5: mod_base = OTHER; note = 2'-fluoro-cytidine
  modified_base 6: mod_base = OTHER; note = 2'-O-methyl-adenosine
  modified_base 7: mod_base = OTHER; note = 2'-fluoro-adenosine
  modified_base 8: mod_base = OTHER; note = 2'-O-methyl-adenosine
  modified_base 9: mod_base = um
  modified_base 10: mod_base = OTHER; note = 2'-fluoro-guanosine
  modified_base 11: mod_base = OTHER; note = 2'-O-methyl-adenosine
  modified_base 12: mod_base = cm
  modified_base 13: mod_base = OTHER; note = 2'-O-methyl-adenosine
  modified_base 14: mod_base = OTHER; note = 2'-fluoro-uridine
  modified_base 15: mod_base = gm
  modified_base 16: mod_base = um
  modified_base 17: mod_base = um
  modified_base 18: mod_base = gm
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tcagcaaatgacatgttgttgg

SEQ ID NO: 1171 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-guanosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = cm
  modified_base 7: mod_base = OTHER; note = 2'-fluoro-uridine
  modified_base 8: mod_base = gm
  modified_base 9: mod_base = cm
  modified_base 10: mod_base = OTHER; note = 2'-fluoro-uridine
  modified_base 11: mod_base = um
  modified_base 12: mod_base = gm
  modified_base 13: mod_base = OTHER; note = 2'-O-methyl-adenosine
  modified_base 14: mod_base = OTHER; note = 2'-fluoro-uridine
  modified_base 15: mod_base = um
  modified_base 16: mod_base = cm
  modified_base 17: mod_base = um
  modified_base 18: mod_base = um
  modified_base 19: mod_base = cm
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tgaaactgcttgattcttcggg

SEQ ID NO: 1172 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-cytidine
  modified_base 5: mod_base = OTHER; note = 2'-fluoro-adenosine
  modified_base 6: mod_base = cm
  modified_base 7: mod_base = OTHER; note = 2'-fluoro-cytidine
  modified_base 8: mod_base = OTHER; note = 2'-O-methyl-adenosine
  modified_base 9: mod_base = cm
  modified_base 10: mod_base = OTHER; note = 2'-fluoro-adenosine
  modified_base 11: mod_base = OTHER; note = 2'-O-methyl-adenosine
  modified_base 12: mod_base = cm
  modified_base 13: mod_base = um
  modified_base 14: mod_base = OTHER; note = 2'-fluoro-guanosine
  modified_base 15: mod_base = gm
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = gm
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tatcaccacaactggcaagggg

SEQ ID NO: 1173 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-cytidine
  modified_base 4: mod_base = OTHER; note = 2'-fluoro-cytidine
  modified_base 5: mod_base = OTHER; note = 2'-fluoro-adenosine
  modified_base 6: mod_base = gm
  modified_base 7: mod_base = OTHER; note = 2'-fluoro-uridine
  modified_base 8: mod_base = um
  modified_base 9: mod_base = um
  modified_base 10: mod_base = OTHER; note = 2'-fluoro-cytidine
  modified_base 11: mod_base = um
  modified_base 12: mod_base = um
  modified_base 13: mod_base = OTHER; note = 2'-O-methyl-adenosine
  modified_base 14: mod_base = OTHER; note = 2'-fluoro-adenosine
  modified_base 15: mod_base = um
  modified_base 16: mod_base = um
  modified_base 17: mod_base = um
  modified_base 18: mod_base = gm
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttccagtttcttaatttgttgg

SEQ ID NO: 1174 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-uridine
  modified_base 5: mod_base = OTHER; note = 2'-fluoro-guanosine
  modified_base 6: mod_base = gm
  modified_base 7: mod_base = OTHER; note = 2'-fluoro-uridine
  modified_base 8: mod_base = um
  modified_base 9: mod_base = gm
  modified_base 10: mod_base = OTHER; note = 2'-fluoro-uridine
  modified_base 11: mod_base = um
  modified_base 12: mod_base = um
  modified_base 13: mod_base = cm
  modified_base 14: mod_base = OTHER; note = 2'-fluoro-cytidine
  modified_base 15: mod_base = OTHER; note = 2'-O-methyl-adenosine
  modified_base 16: mod_base = um
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tactggttgtttccattcaggg

SEQ ID NO: 1175 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-cytidine
  modified_base 4: mod_base = OTHER; note = 2'-fluoro-cytidine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = gm
  modified_base 9: mod_base = gm
  modified_base 10: mod_base = OTHER; note = 2'-fluoro-cytidine
  modified_base 11: mod_base = um
  modified_base 12: mod_base = um
  modified_base 13: mod_base = cm
  modified_base 14: mod_base = OTHER; note = 2'-fluoro-uridine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttccattggcttctcaagatgg

SEQ ID NO: 1176 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-cytidine
  modified_base 8: mod_base = um
  modified_base 9: mod_base = gm
  modified_base 10: mod_base = OTHER; note = 2'-fluoro-cytidine
  modified_base 11: mod_base = um
  modified_base 12: mod_base = um
  modified_base 13: mod_base = gm
  modified_base 14: mod_base = OTHER; note = 2'-fluoro-adenosine
  modified_base 15: mod_base = um
  modified_base 16: mod_base = um
  modified_base 17: mod_base = cm
  modified_base 18: mod_base = um
  modified_base 19: mod_base = um
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
tagaaactgcttgattcttcgg

SEQ ID NO: 1177 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-uridine
  modified_base 6: mod_base = cm
  modified_base 7: mod_base = OTHER; note = 2'-fluoro-adenosine
  modified_base 8: mod_base = cm
  modified_base 9: mod_base = cm
  modified_base 10: mod_base = OTHER; note = 2'-fluoro-adenosine
  modified_base 11: mod_base = cm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-cytidine
  modified_base 15: mod_base = um
  modified_base 16: mod_base = gm
  modified_base 17: mod_base = gm
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tagatcaccacaactggcaagg

SEQ ID NO: 1178 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-guanosine
  modified_base 5: mod_base = OTHER; note = 2'-fluoro-uridine
  modified_base 6: mod_base = um
  modified_base 7: mod_base = OTHER; note = 2'-fluoro-guanosine
  modified_base 8: mod_base = um
  modified_base 9: mod_base = um
  modified_base 10: mod_base = OTHER; note = 2'-fluoro-uridine
  modified_base 11: mod_base = cm
  modified_base 12: mod_base = cm
  modified_base 13: mod_base = OTHER; note = 2'-O-methyl-adenosine
  modified_base 14: mod_base = OTHER; note = 2'-fluoro-uridine
  modified_base 15: mod_base = um
  modified_base 16: mod_base = cm
  modified_base 17: mod_base = OTHER; note = 2'-O-methyl-adenosine
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttggttgtttccattcagatgg

SEQ ID NO: 1179 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-cytidine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = um
  modified_base 9: mod_base = um
  modified_base 10: mod_base = OTHER; note = 2'-fluoro-cytidine
  modified_base 11: mod_base = um
  modified_base 12: mod_base = gm
  modified_base 13: mod_base = um
  modified_base 14: mod_base = OTHER; note = 2'-fluoro-uridine
  modified_base 15: mod_base = cm
  modified_base 16: mod_base = um
  modified_base 17: mod_base = OTHER; note = 2'-O-methyl-adenosine
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tttcattttctgttctagatgg

SEQ ID NO: 1180 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-uridine
  modified_base 6: mod_base = um
  modified_base 7: mod_base = OTHER; note = 2'-fluoro-cytidine
  modified_base 8: mod_base = um
  modified_base 9: mod_base = gm
  modified_base 10: mod_base = OTHER; note = 2'-fluoro-uridine
  modified_base 11: mod_base = um
  modified_base 12: mod_base = cm
  modified_base 13: mod_base = um
  modified_base 14: mod_base = OTHER; note = 2'-fluoro-adenosine
  modified_base 15: mod_base = gm
  modified_base 16: mod_base = OTHER; note = 2'-O-methyl-adenosine
  modified_base 17: mod_base = um
  modified_base 18: mod_base = cm
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tattttctgttctagatcctgg

SEQ ID NO: 1181 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-adenosine
  modified_base 4: mod_base = OTHER; note = 2'-fluoro-cytidine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-uridine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-uridine
  modified_base 11: mod_base = OTHER; note = 2'-O-methyl-adenosine
  modified_base 12: mod_base = um
  modified_base 13: mod_base = OTHER; note = 2'-O-methyl-adenosine
  modified_base 14: mod_base = OTHER; note = 2'-fluoro-adenosine
  modified_base 15: mod_base = OTHER; note = 2'-O-methyl-adenosine
  modified_base 16: mod_base = um
  modified_base 17: mod_base = um
  modified_base 18: mod_base = um
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tcacaataatataaatttttgg

SEQ ID NO: 1182 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-adenosine
  modified_base 8: mod_base = um
  modified_base 9: mod_base = OTHER; note = 2'-O-methyl-adenosine
  modified_base 10: mod_base = OTHER; note = 2'-fluoro-adenosine
  modified_base 11: mod_base = OTHER; note = 2'-O-methyl-adenosine
  modified_base 12: mod_base = um
  modified_base 13: mod_base = um
  modified_base 14: mod_base = OTHER; note = 2'-fluoro-uridine
  modified_base 15: mod_base = um
  modified_base 16: mod_base = um
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
tataatataaatttttacacgg

SEQ ID NO: 1183 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-guanosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = cm
  modified_base 7: mod_base = OTHER; note = 2'-fluoro-uridine
  modified_base 8: mod_base = um
  modified_base 9: mod_base = um
  modified_base 10: mod_base = OTHER; note = 2'-fluoro-uridine
  modified_base 11: mod_base = um
  modified_base 12: mod_base = gm
  modified_base 13: mod_base = cm
  modified_base 14: mod_base = OTHER; note = 2'-fluoro-uridine
  modified_base 15: mod_base = gm
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tgaaactttttgctgcaactgg

SEQ ID NO: 1184 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-adenosine
  modified_base 8: mod_base = OTHER; note = 2'-O-methyl-adenosine
  modified_base 9: mod_base = gm
  modified_base 10: mod_base = OTHER; note = 2'-fluoro-uridine
  modified_base 11: mod_base = um
  modified_base 12: mod_base = um
  modified_base 13: mod_base = OTHER; note = 2'-O-methyl-adenosine
  modified_base 14: mod_base = OTHER; note = 2'-fluoro-cytidine
  modified_base 15: mod_base = OTHER; note = 2'-O-methyl-adenosine
  modified_base 16: mod_base = um
  modified_base 17: mod_base = um
  modified_base 18: mod_base = cm
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttaaaaaagtttacattcttgg

SEQ ID NO: 1185 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-adenosine
  modified_base 6: mod_base = cm
  modified_base 7: mod_base = OTHER; note = 2'-fluoro-adenosine
  modified_base 8: mod_base = um
  modified_base 9: mod_base = um
  modified_base 10: mod_base = OTHER; note = 2'-fluoro-cytidine
  modified_base 11: mod_base = gm
  modified_base 12: mod_base = OTHER; note = 2'-O-methyl-adenosine
  modified_base 13: mod_base = cm
  modified_base 14: mod_base = OTHER; note = 2'-fluoro-uridine
  modified_base 15: mod_base = cm
  modified_base 16: mod_base = um
  modified_base 17: mod_base = um
  modified_base 18: mod_base = gm
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tagaacattcgactcttgcagg

SEQ ID NO: 1186 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-cytidine
  modified_base 6: mod_base = um
  modified_base 7: mod_base = OTHER; note = 2'-fluoro-guanosine
  modified_base 8: mod_base = cm
  modified_base 9: mod_base = OTHER; note = 2'-O-methyl-adenosine
  modified_base 10: mod_base = OTHER; note = 2'-fluoro-uridine
  modified_base 11: mod_base = cm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-fluoro-uridine
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = um
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
taaactgcatcaatgaatctgg

SEQ ID NO: 1187 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-cytidine
  modified_base 6: mod_base = um
  modified_base 7: mod_base = OTHER; note = 2'-fluoro-uridine
  modified_base 8: mod_base = um
  modified_base 9: mod_base = um
  modified_base 10: mod_base = OTHER; note = 2'-fluoro-uridine
  modified_base 11: mod_base = gm
  modified_base 12: mod_base = cm
  modified_base 13: mod_base = um
  modified_base 14: mod_base = OTHER; note = 2'-fluoro-guanosine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = um
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
taaactttttgctgcaactcgg

SEQ ID NO: 1188 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-uridine
  modified_base 4: mod_base = OTHER; note = 2'-fluoro-guanosine
  modified_base 5: mod_base = OTHER; note = 2'-fluoro-adenosine
  modified_base 6: mod_base = um
  modified_base 7: mod_base = OTHER; note = 2'-fluoro-adenosine
  modified_base 8: mod_base = gm
  modified_base 9: mod_base = OTHER; note = 2'-O-methyl-adenosine
  modified_base 10: mod_base = OTHER; note = 2'-fluoro-guanosine
  modified_base 11: mod_base = OTHER; note = 2'-O-methyl-adenosine
  modified_base 12: mod_base = OTHER; note = 2'-O-methyl-adenosine
  modified_base 13: mod_base = cm
  modified_base 14: mod_base = OTHER; note = 2'-fluoro-adenosine
  modified_base 15: mod_base = um
  modified_base 16: mod_base = um
  modified_base 17: mod_base = cm
  modified_base 18: mod_base = gm
  modified_base 19: mod_base = OTHER; note = 2'-O-methyl-adenosine
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
tctgatagagaacattcgacgg

SEQ ID NO: 1189 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = gm
  modified_base 7: mod_base = OTHER; note = 2'-fluoro-uridine
  modified_base 8: mod_base = um
  modified_base 9: mod_base = um
  modified_base 10: mod_base = OTHER; note = 2'-fluoro-adenosine
  modified_base 11: mod_base = cm
  modified_base 12: mod_base = OTHER; note = 2'-O-methyl-adenosine
  modified_base 13: mod_base = um
  modified_base 14: mod_base = OTHER; note = 2'-fluoro-uridine
  modified_base 15: mod_base = cm
  modified_base 16: mod_base = um
  modified_base 17: mod_base = um
  modified_base 18: mod_base = gm
  modified_base 19: mod_base = gm
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
taaaagtttacattcttggggg

SEQ ID NO: 1190 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-cytidine
  modified_base 6: mod_base = um
  modified_base 7: mod_base = OTHER; note = 2'-fluoro-uridine
  modified_base 8: mod_base = cm
  modified_base 9: mod_base = cm
  modified_base 10: mod_base = OTHER; note = 2'-fluoro-adenosine
  modified_base 11: mod_base = um
  modified_base 12: mod_base = gm
  modified_base 13: mod_base = um
  modified_base 14: mod_base = OTHER; note = 2'-fluoro-uridine
  modified_base 15: mod_base = cm
  modified_base 16: mod_base = OTHER; note = 2'-O-methyl-adenosine
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
tattcttccatgttcatcacgg

SEQ ID NO: 1191 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-guanosine
  modified_base 5: mod_base = OTHER; note = 2'-fluoro-adenosine
  modified_base 6: mod_base = gm
  modified_base 7: mod_base = OTHER; note = 2'-fluoro-adenosine
  modified_base 8: mod_base = OTHER; note = 2'-O-methyl-adenosine
  modified_base 9: mod_base = cm
  modified_base 10: mod_base = OTHER; note = 2'-fluoro-adenosine
  modified_base 11: mod_base = um
  modified_base 12: mod_base = um
  modified_base 13: mod_base = cm
  modified_base 14: mod_base = OTHER; note = 2'-fluoro-guanosine
  modified_base 15: mod_base = OTHER; note = 2'-O-methyl-adenosine
  modified_base 16: mod_base = cm
  modified_base 17: mod_base = um
  modified_base 18: mod_base = cm
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttagagaacattcgactcttgg

SEQ ID NO: 1192 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = cm
  modified_base 7: mod_base = OTHER; note = 2'-fluoro-uridine
  modified_base 8: mod_base = gm
  modified_base 9: mod_base = cm
  modified_base 10: mod_base = OTHER; note = 2'-fluoro-adenosine
  modified_base 11: mod_base = um
  modified_base 12: mod_base = cm
  modified_base 13: mod_base = OTHER; note = 2'-O-methyl-adenosine
  modified_base 14: mod_base = OTHER; note = 2'-fluoro-adenosine
  modified_base 15: mod_base = um
  modified_base 16: mod_base = gm
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
tcaaactgcatcaatgaatcgg

SEQ ID NO: 1193 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-guanosine
  modified_base 6: mod_base = OTHER; note = 2'-O-methyl-adenosine
  modified_base 7: mod_base = OTHER; note = 2'-fluoro-guanosine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-cytidine
  modified_base 11: mod_base = OTHER; note = 2'-O-methyl-adenosine
  modified_base 12: mod_base = um
  modified_base 13: mod_base = um
  modified_base 14: mod_base = OTHER; note = 2'-fluoro-cytidine
  modified_base 15: mod_base = gm
  modified_base 16: mod_base = OTHER; note = 2'-O-methyl-adenosine
  modified_base 17: mod_base = cm
  modified_base 18: mod_base = um
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tatagagaacattcgactctgg

SEQ ID NO: 1194 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-uridine
  modified_base 6: mod_base = OTHER; note = 2'-O-methyl-adenosine
  modified_base 7: mod_base = OTHER; note = 2'-fluoro-guanosine
  modified_base 8: mod_base = OTHER; note = 2'-O-methyl-adenosine
  modified_base 9: mod_base = gm
  modified_base 10: mod_base = OTHER; note = 2'-fluoro-adenosine
  modified_base 11: mod_base = OTHER; note = 2'-O-methyl-adenosine
  modified_base 12: mod_base = cm
  modified_base 13: mod_base = OTHER; note = 2'-O-methyl-adenosine
  modified_base 14: mod_base = OTHER; note = 2'-fluoro-uridine
  modified_base 15: mod_base = um
  modified_base 16: mod_base = cm
  modified_base 17: mod_base = gm
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttgatagagaacattcgactgg

SEQ ID NO: 1195 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-cytidine
  modified_base 4: mod_base = OTHER; note = 2'-fluoro-uridine
  modified_base 5: mod_base = OTHER; note = 2'-fluoro-guanosine
  modified_base 6: mod_base = OTHER; note = 2'-O-methyl-adenosine
  modified_base 7: mod_base = OTHER; note = 2'-fluoro-adenosine
  modified_base 8: mod_base = um
  modified_base 9: mod_base = OTHER; note = 2'-O-methyl-adenosine
  modified_base 10: mod_base = OTHER; note = 2'-fluoro-adenosine
  modified_base 11: mod_base = um
  modified_base 12: mod_base = um
  modified_base 13: mod_base = cm
  modified_base 14: mod_base = OTHER; note = 2'-fluoro-adenosine
  modified_base 15: mod_base = cm
  modified_base 16: mod_base = OTHER; note = 2'-O-methyl-adenosine
  modified_base 17: mod_base = cm
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tcctgaataattcacaccaggg

SEQ ID NO: 1196 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-cytidine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = cm
  modified_base 9: mod_base = gm
  modified_base 10: mod_base = OTHER; note = 2'-fluoro-adenosine
  modified_base 11: mod_base = cm
  modified_base 12: mod_base = um
  modified_base 13: mod_base = cm
  modified_base 14: mod_base = OTHER; note = 2'-fluoro-uridine
  modified_base 15: mod_base = um
  modified_base 16: mod_base = gm
  modified_base 17: mod_base = cm
  modified_base 18: mod_base = OTHER; note = 2'-O-methyl-adenosine
  modified_base 19: mod_base = gm
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
taacattcgactcttgcagggg

SEQ ID NO: 1197 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-cytidine
  modified_base 8: mod_base = um
  modified_base 9: mod_base = um
  modified_base 10: mod_base = OTHER; note = 2'-fluoro-adenosine
  modified_base 11: mod_base = gm
  modified_base 12: mod_base = cm
  modified_base 13: mod_base = OTHER; note = 2'-O-methyl-adenosine
  modified_base 14: mod_base = OTHER; note = 2'-fluoro-guanosine
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = gm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttgaatcttagcaggaaggtgg

SEQ ID NO: 1198 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-adenosine
  modified_base 8: mod_base = OTHER; note = 2'-O-methyl-adenosine
  modified_base 9: mod_base = um
  modified_base 10: mod_base = OTHER; note = 2'-fluoro-uridine
  modified_base 11: mod_base = cm
  modified_base 12: mod_base = OTHER; note = 2'-O-methyl-adenosine
  modified_base 13: mod_base = cm
  modified_base 14: mod_base = OTHER; note = 2'-fluoro-adenosine
  modified_base 15: mod_base = cm
  modified_base 16: mod_base = cm
  modified_base 17: mod_base = OTHER; note = 2'-O-methyl-adenosine
  modified_base 18: mod_base = gm
  modified_base 19: mod_base = gm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttgaataattcacaccaggtgg

SEQ ID NO: 1199 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-guanosine
  modified_base 3: mod_base = OTHER; note = 2'-fluoro-uridine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-adenosine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-guanosine
  modified_base 11: mod_base = um
  modified_base 12: mod_base = um
  modified_base 13: mod_base = um
  modified_base 14: mod_base = OTHER; note = 2'-fluoro-adenosine
  modified_base 15: mod_base = cm
  modified_base 16: mod_base = OTHER; note = 2'-O-methyl-adenosine
  modified_base 17: mod_base = um
  modified_base 18: mod_base = um
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tgtaaaaaagtttacattctgg

SEQ ID NO: 1200 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-cytidine
  modified_base 6: mod_base = um
  modified_base 7: mod_base = OTHER; note = 2'-fluoro-uridine
  modified_base 8: mod_base = um
  modified_base 9: mod_base = OTHER; note = 2'-O-methyl-adenosine
  modified_base 10: mod_base = OTHER; note = 2'-fluoro-guanosine
  modified_base 11: mod_base = um
  modified_base 12: mod_base = OTHER; note = 2'-O-methyl-adenosine
  modified_base 13: mod_base = gm
  modified_base 14: mod_base = OTHER; note = 2'-fluoro-uridine
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = um
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
ttgactttagtagtgaactggg

SEQ ID NO: 1201 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-adenosine
  modified_base 5: mod_base = OTHER; note = 2'-fluoro-cytidine
  modified_base 6: mod_base = um
  modified_base 7: mod_base = OTHER; note = 2'-fluoro-uridine
  modified_base 8: mod_base = um
  modified_base 9: mod_base = OTHER; note = 2'-O-methyl-adenosine
  modified_base 10: mod_base = OTHER; note = 2'-fluoro-guanosine
  modified_base 11: mod_base = um
  modified_base 12: mod_base = OTHER; note = 2'-O-methyl-adenosine
  modified_base 13: mod_base = gm
  modified_base 14: mod_base = OTHER; note = 2'-fluoro-uridine
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = um
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
ttgactttagtagtgaactggg

SEQ ID NO: 1202 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-guanosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-cytidine
  modified_base 6: mod_base = OTHER; note = 2'-O-methyl-adenosine
  modified_base 7: mod_base = OTHER; note = 2'-fluoro-uridine
  modified_base 8: mod_base = um
  modified_base 9: mod_base = cm
  modified_base 10: mod_base = OTHER; note = 2'-fluoro-guanosine
  modified_base 11: mod_base = OTHER; note = 2'-O-methyl-adenosine
  modified_base 12: mod_base = cm
  modified_base 13: mod_base = um
  modified_base 14: mod_base = OTHER; note = 2'-fluoro-cytidine
  modified_base 15: mod_base = um
  modified_base 16: mod_base = um
  modified_base 17: mod_base = gm
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tgaacattcgactcttgcaggg

SEQ ID NO: 1203 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-cytidine
  modified_base 5: mod_base = OTHER; note = 2'-fluoro-cytidine
  modified_base 6: mod_base = um
  modified_base 7: mod_base = OTHER; note = 2'-fluoro-guanosine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-uridine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-fluoro-uridine
  modified_base 15: mod_base = cm
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = cm
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
taccctgaataattcacaccgg

SEQ ID NO: 1204 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-guanosine
  modified_base 8: mod_base = um
  modified_base 9: mod_base = um
  modified_base 10: mod_base = OTHER; note = 2'-fluoro-uridine
  modified_base 11: mod_base = OTHER; note = 2'-O-methyl-adenosine
  modified_base 12: mod_base = cm
  modified_base 13: mod_base = OTHER; note = 2'-O-methyl-adenosine
  modified_base 14: mod_base = OTHER; note = 2'-fluoro-uridine
  modified_base 15: mod_base = um
  modified_base 16: mod_base = cm
  modified_base 17: mod_base = um
  modified_base 18: mod_base = um
  modified_base 19: mod_base = gm
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
taaaaagtttacattcttgggg

SEQ ID NO: 1205 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-guanosine
  modified_base 5: mod_base = OTHER; note = 2'-fluoro-uridine
  modified_base 6: mod_base = um
  modified_base 7: mod_base = OTHER; note = 2'-fluoro-guanosine
  modified_base 8: mod_base = um
  modified_base 9: mod_base = um
  modified_base 10: mod_base = OTHER; note = 2'-fluoro-cytidine
  modified_base 11: mod_base = OTHER; note = 2'-O-methyl-adenosine
  modified_base 12: mod_base = gm
  modified_base 13: mod_base = cm
  modified_base 14: mod_base = OTHER; note = 2'-fluoro-uridine
  modified_base 15: mod_base = gm
  modified_base 16: mod_base = cm
  modified_base 17: mod_base = um
  modified_base 18: mod_base = gm
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tatgttgttcagctgctgctgg

SEQ ID NO: 1206 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-uridine
  modified_base 6: mod_base = gm
  modified_base 7: mod_base = OTHER; note = 2'-fluoro-adenosine
  modified_base 8: mod_base = cm
  modified_base 9: mod_base = OTHER; note = 2'-O-methyl-adenosine
  modified_base 10: mod_base = OTHER; note = 2'-fluoro-uridine
  modified_base 11: mod_base = gm
  modified_base 12: mod_base = um
  modified_base 13: mod_base = um
  modified_base 14: mod_base = OTHER; note = 2'-fluoro-guanosine
  modified_base 15: mod_base = um
  modified_base 16: mod_base = um
  modified_base 17: mod_base = cm
  modified_base 18: mod_base = OTHER; note = 2'-O-methyl-adenosine
  modified_base 19: mod_base = gm
  modified_base 20..22: mod_base = OTHER; note = linked via phosphorothioate
  modified_base 20: mod_base = cm
  modified_base 21: mod_base = gm
  modified_base 22: mod_base = gm
  source 1..22: mol_type = other RNA
taaatgacatgttgttcagcgg

SEQ ID NO: 1207 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-cytidine
  modified_base 3: mod_base = OTHER; note = 2'-fluoro-adenosine
  modified_base 4: mod_base = OTHER; note = 2'-fluoro-adenosine
  modified_base 5: mod_base = OTHER; note = 2'-fluoro-adenosine
  modified_base 6: mod_base = um
  modified_base 7: mod_base = OTHER; note = 2'-fluoro-guanosine
  modified_base 8: mod_base = OTHER; note = 2'-O-methyl-adenosine
  modified_base 9: mod_base = cm
  modified_base 10: mod_base = OTHER; note = 2'-fluoro-adenosine
  modified_base 11: mod_base = um
  modified_base 12: mod_base = gm
  modified_base 13: mod_base = um
  modified_base 14: mod_base = OTHER; note = 2'-fluoro-uridine
  modified_base 15: mod_base = gm
  modified_base 16: mod_base = um
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tcaaatgacatgttgttcaggg

SEQ ID NO: 1208 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-uridine
  modified_base 6: mod_base = gm
  modified_base 7: mod_base = OTHER; note = 2'-fluoro-uridine
  modified_base 8: mod_base = um
  modified_base 9: mod_base = gm
  modified_base 10: mod_base = OTHER; note = 2'-fluoro-uridine
  modified_base 11: mod_base = um
  modified_base 12: mod_base = cm
  modified_base 13: mod_base = OTHER; note = 2'-O-methyl-adenosine
  modified_base 14: mod_base = OTHER; note = 2'-fluoro-guanosine
  modified_base 15: mod_base = cm
  modified_base 16: mod_base = um
  modified_base 17: mod_base = gm
  modified_base 18: mod_base = cm
  modified_base 19: mod_base = um
  modified_base 20..22: mod_base = OTHER; note = linked via phosphorothioate
  modified_base 20: mod_base = gm
  modified_base 21: mod_base = gm
  modified_base 22: mod_base = gm
  source 1..22: mol_type = other RNA
tacatgttgttcagctgctggg

SEQ ID NO: 1209 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-uridine
  modified_base 4: mod_base = OTHER; note = 2'-fluoro-uridine
  modified_base 5: mod_base = OTHER; note = 2'-fluoro-adenosine
  modified_base 6: mod_base = um
  modified_base 7: mod_base = OTHER; note = 2'-fluoro-uridine
  modified_base 8: mod_base = um
  modified_base 9: mod_base = cm
  modified_base 10: mod_base = OTHER; note = 2'-fluoro-uridine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-fluoro-adenosine
  modified_base 15: mod_base = gm
  modified_base 16: mod_base = um
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
ttttatttctggaagttaaagg

SEQ ID NO: 1210 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-guanosine
  modified_base 3: mod_base = OTHER; note = 2'-fluoro-adenosine
  modified_base 4: mod_base = OTHER; note = 2'-fluoro-cytidine
  modified_base 5: mod_base = OTHER; note = 2'-fluoro-adenosine
  modified_base 6: mod_base = um
  modified_base 7: mod_base = OTHER; note = 2'-fluoro-guanosine
  modified_base 8: mod_base = um
  modified_base 9: mod_base = um
  modified_base 10: mod_base = OTHER; note = 2'-fluoro-guanosine
  modified_base 11: mod_base = um
  modified_base 12: mod_base = um
  modified_base 13: mod_base = cm
  modified_base 14: mod_base = OTHER; note = 2'-fluoro-adenosine
  modified_base 15: mod_base = gm
  modified_base 16: mod_base = cm
  modified_base 17: mod_base = um
  modified_base 18: mod_base = gm
  modified_base 19: mod_base = cm
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
tgacatgttgttcagctgctgg

SEQ ID NO: 1211 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-adenosine
  modified_base 4: mod_base = OTHER; note = 2'-fluoro-uridine
  modified_base 5: mod_base = OTHER; note = 2'-fluoro-uridine
  modified_base 6: mod_base = um
  modified_base 7: mod_base = OTHER; note = 2'-fluoro-cytidine
  modified_base 8: mod_base = cm
  modified_base 9: mod_base = OTHER; note = 2'-O-methyl-adenosine
  modified_base 10: mod_base = OTHER; note = 2'-fluoro-adenosine
  modified_base 11: mod_base = OTHER; note = 2'-O-methyl-adenosine
  modified_base 12: mod_base = cm
  modified_base 13: mod_base = um
  modified_base 14: mod_base = OTHER; note = 2'-fluoro-guanosine
  modified_base 15: mod_base = cm
  modified_base 16: mod_base = OTHER; note = 2'-O-methyl-adenosine
  modified_base 17: mod_base = um
  modified_base 18: mod_base = cm
  modified_base 19: mod_base = OTHER; note = 2'-O-methyl-adenosine
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
ttatttccaaactgcatcaagg

SEQ ID NO: 1212 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-guanosine
  modified_base 3: mod_base = OTHER; note = 2'-fluoro-cytidine
  modified_base 4: mod_base = OTHER; note = 2'-fluoro-adenosine
  modified_base 5: mod_base = OTHER; note = 2'-fluoro-adenosine
  modified_base 6: mod_base = OTHER; note = 2'-O-methyl-adenosine
  modified_base 7: mod_base = OTHER; note = 2'-fluoro-uridine
  modified_base 8: mod_base = gm
  modified_base 9: mod_base = OTHER; note = 2'-O-methyl-adenosine
  modified_base 10: mod_base = OTHER; note = 2'-fluoro-cytidine
  modified_base 11: mod_base = OTHER; note = 2'-O-methyl-adenosine
  modified_base 12: mod_base = um
  modified_base 13: mod_base = gm
  modified_base 14: mod_base = OTHER; note = 2'-fluoro-uridine
  modified_base 15: mod_base = um
  modified_base 16: mod_base = gm
  modified_base 17: mod_base = um
  modified_base 18: mod_base = um
  modified_base 19: mod_base = cm
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tgcaaatgacatgttgttcagg

SEQ ID NO: 1213 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-adenosine
  modified_base 4: mod_base = OTHER; note = 2'-fluoro-uridine
  modified_base 5: mod_base = OTHER; note = 2'-fluoro-adenosine
  modified_base 6: mod_base = um
  modified_base 7: mod_base = OTHER; note = 2'-fluoro-adenosine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-uridine
  modified_base 11: mod_base = um
  modified_base 12: mod_base = um
  modified_base 13: mod_base = um
  modified_base 14: mod_base = OTHER; note = 2'-fluoro-uridine
  modified_base 15: mod_base = OTHER; note = 2'-O-methyl-adenosine
  modified_base 16: mod_base = cm
  modified_base 17: mod_base = OTHER; note = 2'-O-methyl-adenosine
  modified_base 18: mod_base = cm
  modified_base 19: mod_base = um
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
taatataaatttttacactagg

SEQ ID NO: 1214 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-adenosine
  modified_base 3: mod_base = OTHER; note = 2'-fluoro-uridine
  modified_base 4: mod_base = OTHER; note = 2'-fluoro-cytidine
  modified_base 5: mod_base = OTHER; note = 2'-fluoro-uridine
  modified_base 6: mod_base = gm
  modified_base 7: mod_base = OTHER; note = 2'-fluoro-guanosine
  modified_base 8: mod_base = OTHER; note = 2'-O-methyl-adenosine
  modified_base 9: mod_base = OTHER; note = 2'-O-methyl-adenosine
  modified_base 10: mod_base = OTHER; note = 2'-fluoro-cytidine
  modified_base 11: mod_base = cm
  modified_base 12: mod_base = OTHER; note = 2'-O-methyl-adenosine
  modified_base 13: mod_base = cm
  modified_base 14: mod_base = OTHER; note = 2'-fluoro-adenosine
  modified_base 15: mod_base = OTHER; note = 2'-O-methyl-adenosine
  modified_base 16: mod_base = OTHER; note = 2'-O-methyl-adenosine
  modified_base 17: mod_base = gm
  modified_base 18: mod_base = um
  modified_base 19: mod_base = um
  modified_base 20..22: mod_base = OTHER; note = linked via phosphorothioate
  modified_base 20: mod_base = OTHER; note = 2'-O-methyl-adenosine
  modified_base 21: mod_base = gm
  modified_base 22: mod_base = gm
  source 1..22: mol_type = other RNA
tatctggaaccacaaagttagg

SEQ ID NO: 1215 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-uridine
  modified_base 5: mod_base = OTHER; note = 2'-fluoro-uridine
  modified_base 6: mod_base = gm
  modified_base 7: mod_base = OTHER; note = 2'-fluoro-uridine
  modified_base 8: mod_base = um
  modified_base 9: mod_base = cm
  modified_base 10: mod_base = OTHER; note = 2'-fluoro-adenosine
  modified_base 11: mod_base = gm
  modified_base 12: mod_base = cm
  modified_base 13: mod_base = um
  modified_base 14: mod_base = OTHER; note = 2'-fluoro-guanosine
  modified_base 15: mod_base = cm
  modified_base 16: mod_base = um
  modified_base 17: mod_base = gm
  modified_base 18: mod_base = cm
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttgttgttcagctgctgcttgg

SEQ ID NO: 1216 - RNA, 22 nt, synthetic construct
  modified_base 1..3: mod_base = OTHER; note = linked via phosphorothioate
  modified_base 1: mod_base = OTHER; note = 4 -O-monomethylphosphonate-2 -O-methyluridine
  modified_base 2: mod_base = OTHER; note = 2'-fluoro-uridine
  modified_base 3: mod_base = OTHER; note = 2'-fluoro-guanosine
  modified_base 4: mod_base = OTHER; note = 2'-fluoro-uridine
  modified_base 5: mod_base = OTHER; note = 2'-fluoro-uridine
  modified_base 6: mod_base = gm
  modified_base 7: mod_base = OTHER; note = 2'-fluoro-uridine
  modified_base 8: mod_base = um
  modified_base 9: mod_base = cm
  modified_base 10: mod_base = OTHER; note = 2'-fluoro-adenosine
  modified_base 11: mod_base = gm
  modified_base 12: mod_base = cm
  modified_base 13: mod_base = um
  modified_base 14: mod_base = OTHER; note = 2'-fluoro-guanosine
  modified_base 15: mod_base = cm
  modified_base 16: mod_base = um
  modified_base 17: mod_base = gm
  modified_base 18: mod_base = cm
  modified_base 19: mod_base = um
  modified_base 20..22: mod_base = OTHER; note = linked via phosphorothioate
  modified_base 20: mod_base = um
  modified_base 21: mod_base = gm
  modified_base 22: mod_base = gm
  source 1..22: mol_type = other RNA
ttgttgttcagctgctgcttgg

SEQ ID NO: 1217 - DNA, 4921 bp, Homo sapiens
  source 1..4921: mol_type = genomic DNA
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 1218 - DNA, 4954 bp, unidentified
  source 1..4954: mol_type = genomic DNA; note = non-human primate
tgcatgacggcgtgcctcggccaggctggggctgggcggggattggctgaaggggctgtaattcagcggtttccggagctgcggcggcgtagaccgggagggggagccgggggttccgacgtagcagccgagggaacaagccccaaccggatcctggacaggcaccccggctcggcgctgtctctccccctcggctcggataagccctccggcctgagggagccccgtcgcccgcccccggcgcacgcgcagccccggcctctcggcctctgctggagaaacagcaggatggcccaatggaatcagctacagcagcttgacacacggtacctggagcagctccatcagctctacagtgacagcttcccaatggagttgcggcagtttctggccccttggattgagagtcaagattgggcatatgcggccagcaaagaatcacatgccactttggtgtttcataatctcctgggcgagattgaccagcagtatagccgcttcctgcaagaatcgaatgttctctatcagcacaatctacgaagaatcaagcagtttcttcagagcaggtatcttgagaagccaatggagattgcccggattgtggcccggtgcctgtgggaagagtcacgcctcctacagactgcagccactgcggcccagcaagggggccaggccaaccaccccacagcagctgtggtgacggagaagcagcagatgctggagcagcaccttcaggatgtccggaagagagtacaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacagacgaggagctggctgactggaagaggcggcaacagattgcctgcattggaggtccgcccaacatctgcctagatcggctagaaaactggataacgtcattagcagaatctcaacttcagacccgtcaacaaattaagaaactggaggagttgcagcaaaaagtgtcctacaaaggggaccccattgtacagcaccggccgatgctggaggagagaatcgtggagctgttcagaaacttaatgaaaagtgcctttgtggtggagcggcagccctgcatgcccatgcatcccgaccggccccttgtcatcaagaccggcgtccagttcactaccaaagtcaggttgctggtcaaattccctgagttaaattatcaacttaaaattaaagtgtgcattgacaaagactctggggatgttgcagctctcagaggatcccggaaatttaacattctgggcacaaacaccaaagtgatgaacatggaagagtccaacaacggcagcctctctgcagaattcaaacacttgaccctgagggagcagagatgtgggaatgggggccgagccaattgtgatgcttccctgattgtgactgaggagctgcacctgatcacctttgagacagaggtatatcaccaaggcctcaagattgacctagagacccactccttgccagttgtggtgatctccaacatctgtcagatgccaaatgcctgggcgtccatcctgtggtacaacatgctgaccaacaaccccaagaacgtaaacttttttaccaagcccccaatcggaacctgggatcaagtggccgaggtcctgagctggcagttctcctccaccaccaagcgaggactgagcatcgagcagctgactacactggcggagaaactcttgggacctggcgtgaattattcagggtgtcagatcacatgggctaaattttgcaaagaaaacatggctggcaagggcttctccttctgggtctggctggacaatatcattgaccttgtgaaaaagtacatcctggccctttggaatgaagggtacatcatgggctttatcagtaaggagcgggagcgggccatcttgagcaccaagcctccaggcacctttctgctaagattcagtgaaagcagcaaagaaggcggcgtcactttcacttgggtggagaaggacatcagtggtaagacccagatccagtccgtggaaccatacaccaagcagcagttgaacaacatgtcatttgctgaaatcatcatgggctataagatcatggatgctaccaatattctggtgtctccgctggtctatctctaccctgacattcccaaggaggaggcattcggaaagtattgtcggccagagagccaggagcatcctgaagctgacccaggcgccgccccatacctgaagaccaagtttatctgtgtgacaccattcattgatgcagtttggaaataatggtgaaggtgctgaaccctcagcaggagggcagtttgagtccctcacctttgacatggagttgacctcggagtgtgctacctcccccatgtgaggagctgagaacggaagctgcaaaagatacgactgaggcgcctacctgtgttccgccacccctcacacagccaaaccccagatcatctgaaactactaactttgtggttccagattttttttaatctcctacttctgctatctttgagcaatctgggcacttttaaaaataagagaaatgagtgaatgtgggtgatctgcttttatctaaatgcaaataaggatgtgttctctgagacccgtgatggggggatgtggcggggggtggctagagggagaaaaaggaaatgtcttgtgttgttttgttcccctgccctcctttctcagcagctttttgttattgttgttgttgttcttagacaagtgcctcctggtgcccgcggcatccttctgcctgtttctgtaagcaaatgccacaggccacctgtagctacatactcctggcattgcactttttaaccttgctgacatccaaatagaagataggactatctgagccctaggtttctttttaaattaagaaataagaacaattaaagggcaaaaaacactgtttcagcatagcctttctgtatttaagaaacttcagcagccggccgcagggactcacgcctgtaatcccagcactttgggaggccgaggtgggtggatcatgaggttaggagatcaagactgtcctggctaacatggtgaaaccccgtctctactaacagtacaaaaaattagccgggcgtggtggtgggtgcctgtagtcccagctactcgggaggctgaggcaggagaatggcatgaacccaagaggcggaggttgcagtgagccaaaatcacaccactgcactccaactcaggcaacagtgtgagactccatctcaaaaaaaaaagaaaagaaaaagaaacttcagttaacagcctccttggtgctttaagcattcagcttccttcaggttgataatttatataacccctgaaacaggcttcaggtcaaacccttaaaagacgtctgaagctgcagcctggcctttgatgttgaaataggaaggtttaaggagaatctaagcattttagacttttttttataaatagacttctattttcctttgtaatgtattggtcttttagtgggtaaggctgggcagagggtgcttacaaccttgactccctttctccctggacttgatctgctgtttcagaggctaggttgtttctgtgggtgccttatcagggctgggatacttctgatttgggcttccttcttgccccaccctcccgaccccagttcccctgaccctgctagtggcatgtctcctcccatgtctgaaggtccctcgtcctgtttgttttaggaatcctggtctcaggacctcatggaagaagagggggagaaagttaccagttggatatgatgcagactatggggccccagcgacgtgtctggttgagctcagggaatatggttcttagcccagtttcttggtgatttccagcggtcagttcaggcagggcaaaggcttactgataaacttgagtctgccctcgtatgagggttatagctggcctccctctgaggctggtgactcttccctgctggggccccacaggtgagacagaacaggtagagggcctccctgtctgcccgccttggccagctagcttgcctctcctgtgcgtatgggaacacctagcacgtgctgggtgggctgcctctgacccagaggcatggccgaatttggcgactcaaaaccaccttgcctcagctgatcagagtttctgtggaattctgattgttagatcaaattagctggcctctgaattaagtgggagaggaccttctctaagatgaaccgggttcgccccagtcctcctgcctggagacagttgatgtgtcttgcagagctctcgcttccccagcaacactcttcagtacataataagcttaactgataaacagagagaatatttaggaaggtgagtcttgggcttaccattgggtttaaatcatagggacctcgggaaagggttcgggcttctctggagcagatattatgaagttcatggccttaggtagcatgtgtatctggtcttaactctgattgtagcaaaagttctgagaggagctgagccttgttctggccccttaaagaacagggtcctcaggccctgcccgcttcctgtccactgccctcctgcccgtccccagcccagctgagggaatcccgtgggttgcttacctacctataaggtggtttataagctgctgtcctggccactgcattcaaattccaatgtgtacttcatagtgtaaaaatttatattattgtggggttttttgtcttttttttttttttttttttggtatattgctgtatctactttaacttccagaaataaacgttatataggaaccgtc

SEQ ID NO: 1219 - DNA, 20 bp, synthetic construct
  source 1..20: mol_type = other DNA
ttgtgtttgtgcccagaatg

SEQ ID NO: 1220 - DNA, 23 bp, synthetic construct
  source 1..23: mol_type = other DNA
tccctgagttgaattatcagctt

SEQ ID NO: 1221 - DNA, 25 bp, synthetic construct
  modified_base 1: mod_base = OTHER; note = 6-fluorescein amidite moiety attached
  modified_base 9..10: mod_base = OTHER; note = ZEN quencher
  modified_base 25: mod_base = OTHER; note = Iowa Black FQ moiety attached
  source 1..25: mol_type = other DNA
acgtccccagagtctttgtcaatgc

SEQ ID NO: 1222 - RNA, 36 nt, synthetic construct; identical to SEQ ID NO: 875
  modified_base 1..36: mod_base = OTHER; note = Synthetic
  modified_base 1: mod_base = OTHER; note = octadecanamidodiethoxymethanol-adenosine
  modified_base 2..7: mod_base = OTHER; note = 2'-O-methyl modified nucleotide
  modified_base 8..11: mod_base = OTHER; note = 2'-fluoro modified nucleotide
  modified_base 12..36: mod_base = OTHER; note = 2'-O-methyl modified nucleotide
  source 1..36: mol_type = other RNA

SEQ ID NO: 1223 - RNA, 36 nt, synthetic construct; identical to SEQ ID NO: 862
  modified_base 1..36: mod_base = OTHER; note = Synthetic
  modified_base 1: mod_base = OTHER; note = octadecanamidodiethoxymethanol-uridine
  modified_base 2..7: mod_base = OTHER; note = 2'-O-methyl modified nucleotide
  modified_base 8..11: mod_base = OTHER; note = 2'-fluoro modified nucleotide
  modified_base 12..36: mod_base = OTHER; note = 2'-O-methyl modified nucleotide
  source 1..36: mol_type = other RNA

The invention claimed is:

1. An oligonucleotide for reducing STAT3 expression, the oligonucleotide comprising an antisense strand of 15 to 30 nucleotides in length and a sense strand comprising the sequence set forth in SEQ ID NO: 1222, wherein the sense strand and antisense strand form a duplex region and the antisense strand has a region of complementarity to a target sequence of STAT3 as set forth in SEQ ID NO: 140.

2. The oligonucleotide of claim 1, wherein the antisense strand comprises a sequence as set forth in SEQ ID NO: 965.

3. The oligonucleotide of claim 1, wherein the antisense strand comprises the sequence set forth in SEQ ID NO: 1145.

4. The oligonucleotide of claim 1, wherein the oligonucleotide reduces expression of STAT3 mRNA in one or more immune cells associated with a tumor microenvironment.

5. A pharmaceutical composition comprising the oligonucleotide of claim 1, and a pharmaceutically acceptable carrier, delivery agent, or excipient.

6. An oligonucleotide for reducing STAT3 expression, wherein the oligonucleotide comprises a sense strand comprising the sequence set forth in SEQ ID NO: 1222 and an antisense strand comprising the sequence set forth in SEQ ID NO: 1145, wherein the sense strand and antisense strand form an asymmetric duplex region of 20 nucleotides in length and having an overhang of 2 nucleotides at the 3' terminus of the antisense strand.

7. The oligonucleotide of claim 6, wherein the oligonucleotide reduces expression of STAT3 mRNA in one or more immune cells associated with a tumor microenvironment.

8. A pharmaceutical composition comprising the oligonucleotide of claim 6, and a pharmaceutically acceptable carrier, delivery agent, or excipient.

9. An oligonucleotide for reducing STAT3 expression, wherein the oligonucleotide comprises a sense strand consisting of the sequence set forth in SEQ ID NO: 1222 and an antisense strand consisting of the sequence set forth in SEQ ID NO: 1145, wherein the sense strand and antisense strand form an asymmetric duplex region of 20 nucleotides in length and having an overhang of 2 nucleotides at the 3' terminus of the antisense strand.

10. An oligonucleotide for reducing STAT3 expression, wherein the oligonucleotide consists of a sense strand comprising the sequence set forth in SEQ ID NO: 1222 and an antisense strand comprising the sequence set forth in SEQ ID NO: 1145, wherein the sense strand and antisense strand form an asymmetric duplex region of 20 nucleotides in length and having an overhang of 2 nucleotides at the 3' terminus of the antisense strand.

11. The oligonucleotide of claim 10, wherein the oligonucleotide reduces expression of STAT3 mRNA in one or more immune cells associated with a tumor microenvironment.

12. A pharmaceutical composition comprising the oligonucleotide of claim 10, and a pharmaceutically acceptable carrier, delivery agent, or excipient.

* * * * *